(12) United States Patent
McBride et al.

(10) Patent No.: US 9,745,560 B2
(45) Date of Patent: Aug. 29, 2017

(54) EXPRESSION OF ENZYMES IN YEAST FOR LIGNOCELLULOSE DERIVED OLIGOMER CBP

(71) Applicant: Lallemand Hungary Liquidity Management LLC, Budapest (HU)

(72) Inventors: John E. McBride, Lyme, NH (US); Erin Wiswall, Danbury, NH (US); Indraneel Shikhare, Houston, TX (US); Haowen Xu, Yorktown Heights, NY (US); Naomi Thorngren, Norwich, VT (US); Heidi H. Hau, St. Paul, MN (US); Emily Stonehouse, Lebanon, NH (US)

(73) Assignee: Lallemand Hungary Liquidity Management LLC, Budapest (HU)

( * ) Notice: Subject to any disclaimer, the term of this patent is extended or adjusted under 35 U.S.C. 154(b) by 0 days.

(21) Appl. No.: 14/424,560

(22) PCT Filed: Mar. 15, 2013

(86) PCT No.: PCT/US2013/000090
§ 371 (c)(1),
(2) Date: Feb. 27, 2015

(87) PCT Pub. No.: WO2014/035458
PCT Pub. Date: Mar. 6, 2014

(65) Prior Publication Data
US 2015/0225705 A1    Aug. 13, 2015

Related U.S. Application Data

(60) Provisional application No. 61/694,690, filed on Aug. 29, 2012.

(51) Int. Cl.
| | |
|---|---|
| C12N 1/20 | (2006.01) |
| C12N 9/18 | (2006.01) |
| C12P 19/02 | (2006.01) |
| C12P 19/14 | (2006.01) |
| C12N 9/24 | (2006.01) |
| C12P 7/10 | (2006.01) |
| C12N 9/42 | (2006.01) |
| C12N 9/40 | (2006.01) |
| C12N 9/38 | (2006.01) |
| C12P 3/00 | (2006.01) |
| C12P 7/16 | (2006.01) |
| C12P 7/28 | (2006.01) |
| C12P 7/52 | (2006.01) |
| C12P 7/56 | (2006.01) |

(52) U.S. Cl.
CPC ............ *C12N 9/18* (2013.01); *C12N 9/2402* (2013.01); *C12N 9/248* (2013.01); *C12N 9/2437* (2013.01); *C12N 9/2445* (2013.01); *C12N 9/2465* (2013.01); *C12N 9/2471* (2013.01); *C12N 9/2482* (2013.01); *C12N 9/2491* (2013.01); *C12N 9/2494* (2013.01); *C12P 3/00* (2013.01); *C12P 7/10* (2013.01); *C12P 7/16* (2013.01); *C12P 7/28* (2013.01); *C12P 7/52* (2013.01); *C12P 7/56* (2013.01); *C12P 19/02* (2013.01); *C12P 19/14* (2013.01); *C12Y 301/01072* (2013.01); *C12Y 301/01006* (2013.01); *C12Y 302/01021* (2013.01); *C12Y 302/01037* (2013.01); *C12Y 302/01072* (2013.01); *C12Y 302/01131* (2013.01); *C12Y 302/01139* (2013.01); *Y02E 50/16* (2013.01)

(58) Field of Classification Search
CPC .................... C12P 19/02; C12Y 302/01037
USPC ....................... 435/139, 183, 254.2
See application file for complete search history.

(56) References Cited

U.S. PATENT DOCUMENTS

| | | |
|---|---|---|
| 2006/0234364 A1 | 10/2006 | Rajgarhia et al. |
| 2006/0257983 A1 | 11/2006 | Bro et al. |
| 2011/0201084 A1 | 8/2011 | Wyman et al. |

(Continued)

FOREIGN PATENT DOCUMENTS

| | | |
|---|---|---|
| EP | 0507369 * | 10/1992 |
| EP | 2 277 989 A1 | 1/2011 |
| WO | 00/71729 A2 | 11/2000 |

(Continued)

OTHER PUBLICATIONS

Andersen, M. R. et al., "Comparative genomics of citric-acid-producing Aspergillus niger ATCC 1015 versus enzyme-producing CBS 513.88," Genome Res., 2011, v. 21, pp. 885-897.
Ansell, R., et al., "The two isoenzymes for yeast NAD-dependent glycerol 3-phosphate dehydrogenase encoded by GDP1 and GDP2 have distinct roles in osmoadaptation and redox regulation," The EMBO Journal 16(9):2179-2187, Nature Publishing Group, England (1997).
Bailey, M. J., et al., "Interlaboratory testing of methods for assay of xylanase activity," J. Biotechnol., 1992, v. 23, pp. 257-270.

(Continued)

*Primary Examiner* — Tekchand Saidha
(74) *Attorney, Agent, or Firm* — Nutter McClennen & Fish LLP

(57) ABSTRACT

The present invention provides a multi-component enzyme system that hydrolyzes hemicellulose oligomers from hardwood which can be expressed, for example, in yeast such as *Saccharomyces cerevisiae*. In some embodiments, this invention provides for the engineering of a series of biocatalysts combining the expression and secretion of components of this enzymatic system with robust, rapid xylose utilization, and ethanol fermentation under industrially relevant process conditions for consolidated bioprocessing. In some embodiments, the invention utilizes co-cultures of strains that can achieve significantly improved performance due to the incorporation of additional enzymes in the fermentation system.

43 Claims, 89 Drawing Sheets

(56) References Cited

U.S. PATENT DOCUMENTS

| | | |
|---|---|---|
| 2012/0322078 A1 | 12/2012 | Mcbride et al. |
| 2013/0273555 A1 | 10/2013 | Sillers et al. |

FOREIGN PATENT DOCUMENTS

| | | | |
|---|---|---|---|
| WO | 03/062430 A1 | | 7/2003 |
| WO | 2006/009434 A1 | | 1/2006 |
| WO | 2009146464 | * | 12/2009 |
| WO | 2011/140386 A2 | | 11/2011 |
| WO | 2011/153516 A2 | | 12/2011 |
| WO | 2012/138942 A1 | | 10/2012 |
| WO | 2013/071112 A1 | | 5/2013 |
| WO | 2014/081803 A1 | | 5/2014 |

OTHER PUBLICATIONS

Bro, C., et al., "In silico aided metabolic engineering of *Saccharomyces cerevisiae* for improved bioethanol production," Metabolic Engineering 8:102-111, Elsevier Inc., United States (2006).

Casey, G. P., et al., "A convenient dominant selection marker for gene transfer in industrial strains of *Saccharomyces* yeast: SMR1 encoded resistance to the herbicide sulfometuron methyl," J. Inst. Brew., 1988, v. 94, pp. 93-97.

Demain, A. L., et al., "Cellulase, Clostridia, and Ethanol," Microbiol. Mol. Biol. Rev. 69:124-154, American Society for Microbiology, United States (2005).

Den Haan, R., et al., "Hydrolysis and fermentation of amorphous cellulose by recombinant *Saccharomyces cerevisiae*," Metabolic Engineering 9:87-94, Academic Press, United States (2007).

Guo, Z.P. et al., "Minimization of glycerol synthesis in industrial ethanol yeast without influencing its fermentation performance," Metab Eng. Jan. 2011;13(1):49-59. doi: 10.1016/j.ymben.2010.11.003. Epub Nov. 30, 2010.

Hahn-Hägerdal, B., et al., "Metabolic Engineering of *Saccharomyces cerevisiae* for Xylose Utilization," Adv. in Biochem. Eng. Biotechnol. 73:53-84, Springer-Verlag, Germany (2001).

Invitation to Pay Additional Fees for Application No. PCT/US2013/000090, dated Jul. 10, 2013 (10 pages).

International Search Report and Written Opinion for Application No. PCT/US2013/000090, mailed Sep. 30, 2013 (21 pages).

Jeppsson, M., et al., Reduced Oxidative Pentose Phosphate Pathway Flux in Recombinant Xylose-Utilizing *Saccharomyces cerevisiae* Strains Improves the Ethanol Yield from Xylose, Appl. Environ. Microbiol. 68 (4):1604-1609, American Society for Microbiology, Washington, United States (2002).

Karhumaa, K., et al., "Comparison of the xylose reductase-xylitol dehydrogenase and the xylose isomerase pathways for xylose fermentation by recombinant *Saccharomyces cerevisiae*," Microbiol Cell Factories 6(5):1-10, BioMed Central, England (2007).

Kim, Y., et al., "Reaction mechanisms and kinetics of xylo-oligosaccharide hydrolysis by dicarboxylic acids," AIChE Journal, 2013, vol. 59, pp. 188-199.

Lidén, G., et al., "A Glycerol-3-Phosphate Dehydrogenase-Deficient Mutant of *Saccharomyces cerevisiae* Expressing the Heterologous XYL1 Gene," Appl. Environ. Microbiol., 62(10):3894-3896, American Society for Microbiology, United States (1996).

Lynd, L.R., et al., "Microbial Cellulose Utilization: Fundamentals and Biotechnology," Microbiology and Molecular Biology Reviews, 66(3):506-577, American Society for Microbiology, United States (2002).

McBride, J., et al., "Development of an efficient consolidated bioprocessing catalyst for hardwood derived hemicellulose oligomers," (Abstract) 13th Int'l Congress on Yeasts, Aug. 30, 2012, XP055067478, <:http://conferencing.uwex.edu/conferences/icy2012/documents/I-11.pdf.

Medina, V.G., et al., "Elimination of Glycerol Production in Anaerobic Cultures of a *Saccharomyces cerevisiae* Strain Engineered to Use Acetic Acid as an Electron Acceptor," Applied and Environmental Microbiology, 76(1):190-195, American Society for Microbiology., United States (Jan. 2010).

[No Author Listed] Database UniProt (online), Mar. 6, 2007, "RecName: Full=Probable acetylxylan esterase A; =EC=3.1.1.72; Flags: Precursor;" XP002699328, retrieved from EBI accession No. UNIPROT:A2QZI3.

[No Author Listed] Database UniProt (online), Mar. 6, 2007, "RecName: Full=Probable endo-1,4-beta-xylanase C; Short=Xylanase C; EC=3.2.1 .8; AltName: Full=I,4-beta-D-xylan xylanohydrolase C; Flags: Precursor;" XP002699329, retrieved from EBI accession No. UNIPROT:A2QFV7.

[No Author Listed] Database UniProt (online), Sep. 23, 2008, "RecName: Full=Probable exo-1,4-beta-xylosidase xInD; EC=3.2.1.37; AltName: Full=1,4-beta-D-xylan xylohydrolase xInD; AltName: Full=Beta-xylosidase A; AltName: Full=Beta-xylosidase xInD; Al tName: Full=Xylobiase xInD; Flags: Precursor;" XP002699330, retrieved from EBI accession No. UNIPROT:A2QA27.

Olson, D. G. et al., "Recent progress in consolidated bioprocessing," Curr. Opin. Biotechnol., 2012, v 23, pp. 396-405.

Páhlman, A-K., et al., "The Yeast Glycerol 3-Phosphatases Gpp1p and Gpp2p Are Required for Glycerol Biosynthesis and Differentially Involved in the Cellular Response to Osmotic, Anaerobic, and Oxidative Stress," J. Biol. Chem., 276(5):3555-3563, American Society for Biochemistry and Molecular Biology, United States (2001).

Qing, Q., et al., "Supplementation with xylanase and b-xylosidase to reduce xylo-oligomer and xylan inhibition of enzymatic hydrolysis of cellulose and pretreated corn stover," Biotech. for Biofuels, 2011, v. 4, p. 1-12.

Qing, Q., et al., "Xylooligomers are strong inhibitors of cellulose hydrolysis by enzymes," Bioresource Technology, 2010, v. 101, pp. 9624-9630.

Shallom, D. et al., "Microbial hemicellulases," Curr. Opin. Microbiol., 2003, v. 6, pp. 219-228.

Shanks, R.M.Q. et al., "*Saccharomyces cerevisiae*-based Molecular Tool Kit for Manipulation of Genes from Gram-Negative Bacteria," Appl. Environ. Microbiol., 2006, 72(7): 5027-5036.

Spanikova, S., et al., "Glucuronoyl esterase-novel carbohydrate esterase produced by *Schizophyllum commune*," FEBS Lett. Aug. 21, 2006;580(19):4597-601. Epub Jul. 21, 2006.

Sun, Y. and Cheng, J., "Hydrolysis of Lignocellulosic Materials for Ethanol Production: A Review," Bioresource Technol., 83:1-11, Elsevier, Holland (2002).

Tamás, M.J., et al., "Fps1p controls the accumulation and release of the compatible solute glycerol in yeast osmoregulation," Molecular Microbiology, 31(4):1087-1104, Blackwell Science Ltd, England (1999).

Van Zyl, W.H., et al., "Consolidated Bioprocessing for Bioethanol Production using *Saccharomyces cerevisiae*," Advances in Biochemical Engineering Biotechnology, 108:205-235, Springer-Verlag, Germany (2007).

Zhang, J. et al., "The role of acetyl xylan esterase in the solubilization of xylan and enzymatic hydrolysis of wheat straw and giant reed," Biotechnol. for Biofuels, 2011, v4, p. 60 (10 pages).

* cited by examiner

A

B

EXPRESSION OF ENZYMES IN YEAST FOR LIGNOCELLULOSE DERIVED OLIGOMER CBP

STATEMENT REGARDING FEDERALLY-SPONSORED RESEARCH AND DEVELOPMENT

This invention was funded, in part, by the United States government under a grant with the Department of Energy, Award No. DE-FC36-08G018103. This invention was also funded, in part, by the Bioenergy Science Center, Oak Ridge National Laboratory, a U.S. Department of Energy Bioenergy Research Center supported by the Office of Biological and Environmental Research, under contract DE-PS02-06ER64304. The U.S. Government has certain rights in this invention.

REFERENCE TO SEQUENCE LISTING

The content of the sequence listing filed with the application is incorporated herein by reference in its entirety.

BACKGROUND OF THE INVENTION

Energy conversion, utilization, and access underlie many of the great challenges of our time, including those associated with sustainability, environmental quality, security, and poverty. New applications of emerging technologies are required to respond to these challenges. Biotechnology, one of the most powerful of the emerging technologies, can give rise to important new energy conversion processes. Plant biomass and derivatives thereof are a resource for the biological conversion of energy to forms useful to humanity.

Biomass is from living, or recently living organisms, such as wood, waste, (hydrogen) gas, and alcohol fuels. Biomass is carbon, hydrogen, and oxygen based. Nitrogen and small quantities of other atoms, including alkali, alkaline earth and heavy metals can be found as well. Metals are often found in functional molecules such as the porphyrins which include chlorophyll which contains magnesium. Plants in particular combine water and carbon dioxide to sugar building blocks. The required energy is produced from light via photosynthesis based on chlorophyll. On average, between 0.1% and 1% of the available light is stored as chemical energy in plants. The sugar building blocks are the starting point for all of the major fractions found in terrestrial plants, lignin, hemicellulose, and cellulose. Biomass is widely recognized as a promising source of raw material for production of renewable fuels and chemicals. The primary obstacle impeding the more widespread production of energy from biomass feedstocks is the general absence of low-cost technology for overcoming the recalcitrance of these materials to conversion into useful fuels. Biomass contains carbohydrate fractions (e.g., starch, cellulose, and hemicellulose) that can be converted into ethanol. In order to convert these fractions, the starch, cellulose, and hemicellulose must ultimately be converted or hydrolyzed into monosaccharides; it is the hydrolysis that has historically proven to be problematic.

Biologically mediated processes are promising for energy conversion, in particular, for the conversion of biomass into fuels. Biomass processing schemes involving enzymatic or microbial hydrolysis commonly involve four biologically mediated transformations: (1) the production of saccharolytic enzymes (amylases, cellulases, and hemicellulases); (2) the hydrolysis of carbohydrate components present in pretreated biomass to sugars; (3) the fermentation of hexose sugars (e.g., glucose, mannose, and galactose); and (4) the fermentation of pentose sugars (e.g., xylose and arabinose). These four transformations occur in a single step in a process configuration called consolidated bioprocessing (CBP), which is distinguished from other less highly integrated configurations in that it does not involve a dedicated process step for cellulase and/or hemicellulase production.

CBP offers the potential for lower cost and higher efficiency than processes featuring dedicated saccharolytic enzyme production. The benefits result in part from avoided capital costs, substrate, and other raw materials, and utilities associated with saccharolytic enzyme production. In addition, several factors support the realization of higher rates of hydrolysis, and hence reduced reactor volume and capital investment using CBP, including enzyme-microbe synergy and the use of thermophilic organisms and/or complexed saccharolytic systems. Moreover, cellulose-adherent cellulolytic microorganisms are likely to compete successfully for products of cellulose hydrolysis with non-adhered microbes, e.g., contaminants, which could increase the stability of industrial processes based on microbial cellulose utilization. Progress in developing CBP-enabling microorganisms is being made through two strategies: engineering naturally occurring saccharolytic microorganisms to improve product-related properties, such as yield and titer; and engineering non-saccharolytic organisms that exhibit high product yields and titers to express a heterologous saccharolytic enzyme system enabling starch, cellulose, and hemicellulose utilization.

The breakdown of starch down into sugar requires amylolytic enzymes. Amylase is an example of an amylolytic enzyme that is present in human saliva, where it begins the chemical process of digestion. The pancreas also makes amylase (alpha amylase) to hydrolyze dietary starch into disaccharides and trisaccharides which are converted by other enzymes to glucose to supply the body with energy. Plants and some bacteria also produce amylases. Amylases are glycoside hydrolases and act on α-1,4-glycosidic bonds.

Several amylolytic enzymes are implicated in starch hydrolysis. Alpha-amylases (EC 3.2.1.1) (alternate names: 1,4-α-D-glucan glucanohydrolase; glycogenase) are calcium metalloenzymes, i.e., completely unable to function in the absence of calcium. By acting at random locations along the starch chain, alpha-amylase breaks down long-chain carbohydrates, ultimately yielding maltotriose and maltose from amylose, or maltose, glucose and "limit dextrin" from amylopectin. Because it can act anywhere on the substrate, alpha-amylase tends to be faster-acting than beta-amylase. Another form of amylase, beta-amylase (EC 3.2.1.2) (alternate names: 1,4-α-D-glucan maltohydrolase; glycogenase; saccharogen amylase) catalyzes the hydrolysis of the second α-1,4 glycosidic bond, cleaving off two glucose units (maltose) at a time. The third amylase is gamma-amylase (EC 3.2.1.3) (alternate names: Glucan 1,4-α-glucosidase; amyloglucosidase; Exo-1,4-α-glucosidase; glucoamylase; lysosomal α-glucosidase; 1,4-α-D-glucan glucohydrolase). In addition to cleaving the last α(1-4)glycosidic linkages at the nonreducing end of amylose and amylopectin, yielding glucose, gamma-amylase will cleave α(1-6) glycosidic linkages.

A fourth enzyme, alpha-glucosidase, acts on maltose and other short malto-oligosaccharides produced by alpha-, beta-, and gamma-amylases, converting them to glucose.

Three major types of enzymatic activities are required for native cellulose degradation. The first type are endoglucanases (1,4-β-D-glucan 4-glucanohydrolases; EC 3.2.1.4).

Endoglucanases cut at random in the cellulose polysaccharide chain of amorphous cellulose, generating oligosaccharides of varying lengths and consequently new chain ends. The second type are exoglucanases, including cellodextrinases (1,4-β-D-glucan glucanohydrolases; EC 3.2.1.74) and cellobiohydrolases (1,4-β-D-glucan cellobiohydrolases; EC 3.2.1.91). Exoglucanases act in a processive manner on the reducing or non-reducing ends of cellulose polysaccharide chains, liberating either glucose (glucanohydrolases) or cellobiose (cellobiohydrolase) as major products. Exoglucanases also act on microcrystalline cellulose, presumably peeling cellulose chains from the microcrystalline structure. The third type are β-glucosidases (β glucoside glucohydrolases; EC 3.2.1.21). β-glucosidases hydrolyze soluble cellodextrins and cellobiose to glucose units.

A variety of plant biomass resources are available as starch and lignocellulosics for the production of biofuels, notably bioethanol. The major sources of plant biomass resources are (i) wood residues from paper mills, sawmills, and furniture manufacturing, (ii) municipal solid wastes, (iii) agricultural residues, and (iv) energy crops such as corn. Pre-conversion of particularly the cellulosic fraction in these biomass resources (using physical, chemical, or enzymatic processes) to fermentable sugars (glucose, cellobiose, maltose, alpha- and cellodextrins) would enable their fermentation to bioethanol, provided the necessary fermentative micro-organism with the ability to utilize these sugars is used.

On a world-wide basis, $1.3 \times 10^{10}$ metric tons (dry weight) of terrestrial plants are produced annually (Demain, A. L., et al., *Microbiol. Mol. Biol. Rev.* 69:124-154 (2005)). Plant biomass consists of about 40%-55% cellulose, 25%-50% hemicellulose and 10%-40% lignin, depending whether the source is hardwood, softwood, or grasses (Sun, Y. and Cheng, J., *Bioresource Technol.* 83:1-11 (2002)). The major polysaccharide present is water-insoluble, cellulose that contains the major fraction of fermentable sugars (glucose, cellobiose or cellodextrins).

Hemicellulose oligomers represent a significant portion of lignocellulosic feedstocks. In hardwood species, carbohydrate structures with monomeric components including xylose, mannose, galactose, and arabinose make up as much as 20% of the feedstock by weight. Several methods of biomass pretreatment produce a mixture of soluble oligomers and monomers, including xylo-oligomers and gluco-oligomers in addition to those cited above. In addition, an insoluble fraction containing glucan, additional hemicellulose oligomers, and lignin is produced. Aqueous pretreatments in particular leave hemicellulose oligomers intact, and the conversion of this mixture of soluble oligomers is achieved using acid hydrolysis (Kim, Y., Kreke, T., Ladisch, M. R. Reaction mechanisms and kinetics of xylo-oligosaccharide hydrolysis by dicarboxylic acids. *AICHe Journal*. (2012). Article first published online: 23 Apr. 2012) or enzymatic hydrolysis prior to fermentation, with varying degrees of efficiency and cost. Acid hydrolysis in particular requires increased costs due to reaction vessels that require the ability to withstand low pH, high temperature, and pressure, although high yields have been reported (Kim, Y., Kreke, T., Ladisch, M. R. Reaction mechanisms and kinetics of xylo-oligosaccharide hydrolysis by dicarboxylic acids. *AICHe Journal*. (2012). Article first published online: 23 Apr. 2012). In addition, it is known that the hydrolysis of xylo-oligomers is very important for improving the kinetics of cellulose hydrolysis by cellulase as these enzymes are very inhibited by these oligomers (Qing, Q., Yang, B., Wyman, C. E. Xylooligomers are strong inhibitors of cellulose hydrolysis by enzymes. *Bioresource Technol.* 101: 9624-9630 (2010); see also U.S. application Ser. No. 13/055,366, published as U.S. Pub. No. 2011/0201084). As shown below, several commercially available enzyme preparations are relatively poor at achieving high yield enzymatic hydrolysis of substituted, soluble oligomers derived from hardwood.

Bakers' yeast (*Saccharomyces cerevisiae*) remains the preferred micro-organism for the production of ethanol (Hahn-Hagerdal, B., et al., *Adv. Biochem. Eng. Biotechnol.* 73:53-84 (2001)). Attributes in favor of this microbe are (i) high productivity at close to theoretical yields (0.51 g ethanol produced/g glucose used), (ii) high osmo- and ethanol tolerance, (iii) natural robustness in industrial processes, (iv) being generally regarded as safe (GRAS) due to its long association with wine and bread making, and beer brewing. Furthermore, *S. cerevisiae* exhibits tolerance to inhibitors commonly found in hydrolyzates resulting from biomass pretreatment. The major shortcoming of *S. cerevisiae* is its inability to utilize complex polysaccharides such as starch, cellulose, and polymeric hemicellulose or its break-down products, such as cellobiose, xylose, and cellodextrins.

As noted above, ethanol producing yeast such as *S. cerevisiae* require addition of external cellulases when cultivated on cellulosic substrates such as pre-treated wood because this yeast does not produce endogenous cellulases. Functional expression of fungal cellulases such as *T. reesei* CBH1 and CBH2 in yeast *S. cerevisiae* have been demonstrated (Den Haan R et al., *Metab. Eng.*, 9:87-94 (2007)). However, current levels of expression and specific activity of cellulases heterologously expressed in yeast are still not maximally efficient with respect to the lignocellulosic substrate. Thus, there remains a significant need for improvement in the amount and variety of cellulase activity expressed in order to attain the goal of achieving a consolidated bioprocessing (CBP) system capable of efficiently and cost-effectively converting cellulosic substrates to ethanol.

The composition of lignocellulosic material varies greatly based on its species of origin, the particular tissue from which it is derived, and its pretreatment. Because of its varied composition, organisms designed for CBP must produce digestive enzymes that can accommodate a variety of substrates, in a variety of conformations, in a variety of reaction environments. To date, efficient usage of lignocellulosic substrates requires the addition of external enzymes at high levels. However, externally added enzymes are costly. Therefore, it would be very beneficial to isolate cellulases from cellulolytic organisms with high specific activity and high expression levels in host organisms, such as the yeast *S. cerevisiae* in order to achieve CBP. Also, in order to use lignocellulosic material with maximal efficiency, it would also be beneficial to discover combinations of paralogous and/or orthologous enzymes that work synergistically to achieve more efficient break down of lignocellulosic components.

Beyond fungi, there are a large variety of cellulolytic bacteria that can be used as gene donors for expression of lignocellulolytic enzymes in yeast. In one aspect, the present invention is drawn to identifying cellulolytic enzymes from a variety of organisms and subsequently identifying enzymes that work in maximally efficient combinations to digest lignocellulosic material. Given the diversity of cellulolytic bacteria, classification of these organisms based on several parameters (Lynd, L. R., et al., Microbial Cellulose Utilization: Fundamentals and Biotechnology. *Microbiol. Mol. Biol. Rev.*, 66:506-577 (2002)) can inform the choice of gene donors. The following are distinguishing characteristics: (A) aerobic vs. anaerobic, (B) mesophiles vs. thermophiles; and (C) noncomplexed, cell free enzymes vs. complexed, cell bound enzymes.

Another consideration when defining the needed set of enzymatic activities is to attempt to characterize the linkages in a lignocellulosic substrate. FIGS. 1A-1D provide an overview of the carbohydrate structures present in plant material given in Van Zyl, W. H., et al., Consolidated bioprocessing for bioethanol production using *Saccharomyces cerevisiae, Adv. Biochem. Eng. Biotechnol.*, 108:205-235 (2007). Intl Pub. No. WO2011/153516, which is herein incorporated by reference, provides an analysis of hardwood substrate.

BRIEF SUMMARY OF THE INVENTION

Aspects of the invention are directed to a multi-enzyme system that is able to convert up to about 95% of the oligomers present in a process stream to monomers. In some embodiments, the invention is directed to host cells that express components of the multi-enzyme system.

In one aspect of the present invention, a multi-component enzyme system is identified and expressed in yeast, such as *Saccharomyces cerevisiae*. In its purified form, the enzyme system is able to convert up to about 95% of the oligomers present in a process stream to monomer at low enzyme loadings. The enzyme system is far more efficient for hydrolyzing hemicellulose oligomers from hardwood as compared to several commercially available enzyme products, achieving high yield at ~2.5 mg enzyme per gram of total xylose present (determined by acid hydrolysis of starting material), whereas only low yields were achieved with commercial enzymes at 10 mg/g xylose present. In addition, other aspects of the invention present the engineering of a series of biocatalysts combining the expression and secretion of components of this enzymatic system with robust, rapid xylose utilization, and ethanol fermentation under industrially relevant process conditions for consolidate bioprocessing. Other aspects of this invention utilize a co-culture of strains that achieve significantly improved performance due to the incorporation of additional enzymes in the fermentation system. These strains and combinations thereof provide a way to directly convert the oligomers produced during the pretreatment of lignocellulosic feedstocks into ethanol without introducing additional processing steps like acid hydrolysis or enzymatic hydrolysis.

In one embodiment, the invention relates to a recombinant yeast host cell, comprising: a heterologous polynucleotide comprising a nucleic acid which encodes an acetylxylanesterase; a heterologous polynucleotide comprising a nucleic acid which encodes a xylanase; and a heterologous polynucleotide comprising a nucleic acid which encodes a xylosidase. In some embodiments, the polynucleotide encoding acetylxylanesterase comprises a nucleic acid which encodes a polypeptide comprising an amino acid sequence at least about 90%, 95%, 96%, 97%, 98% or 99% identical to any one of SEQ ID NOs:6-10. In some embodiments, the polynucleotide encoding xylanase comprises a nucleic acid which encodes a polypeptide comprising an amino acid sequence at least about 90%, 95%, 96%, 97%, 98% or 99% identical to any one of SEQ ID NOs:37-62. In some embodiments, the heterologous polypeptide encoding xylosidase comprises a nucleic acid which encodes a polypeptide comprising an amino acid sequence at least about 90%, 95%, 96%, 97%, 98% or 99% identical to any one of SEQ ID NOs:78-92. In some embodiments, the acetylxylanesterase, the xylanase, or the xylosidase comprise a histidine tag.

In some embodiments of the invention, the recombinant host cell comprises at least one saccharolytic enzyme and further comprises a heterologous polynucleotide comprising a nucleic acid which encodes a galactosidase. In some embodiments, the heterologous polypeptide encoding galactosidase comprises a nucleic acid which encodes a polypeptide comprising an amino acid sequence at least about 90%, 95%, 96%, 97%, 98% or 99% identical to any one of SEQ ID NOs:108-122. In some embodiments of the invention, the recombinant host cell comprises at least one saccharolytic enzyme and further comprises a heterologous polynucleotide comprising a nucleic acid which encodes a mannosidase. In some embodiments, the heterologous polypeptide encoding mannosidase comprises a nucleic acid which encodes a polypeptide comprising an amino acid sequence at least about 90%, 95%, 96%, 97%, 98% or 99% identical to any one of SEQ ID NOs:146-168. In some embodiments of the invention, the recombinant host cell comprises at least one saccharolytic enzyme and further comprises a heterologous polynucleotide comprising a nucleic acid which encodes an alpha-glucuronidase. In some embodiments, the heterologous polypeptide encoding alpha-glucuronidase comprises a nucleic acid which encodes a polypeptide comprising an amino acid sequence at least about 90%, 95%, 96%, 97%, 98% or 99% identical to any one of SEQ ID NOs:184-198.

In some embodiments, the recombinant host cell comprises nucleic acids encoding polypeptides comprising amino acid identical to SEQ ID NOs:8, 37, and 78. In some embodiments, the host cell further comprises a nucleic acid which encodes a polypeptide comprising an amino acid sequence that encodes for alpha-galactosidase. In some embodiments, the nucleic acid is SEQ ID NO:108. In some embodiments, the host cell further comprises a nucleic acid which encodes a polypeptide comprising an amino acid sequence that encodes for mannosidase. In some embodiments, the nucleic acid is SEQ ID NO:146. In some embodiments, the host cell further comprises a nucleic acid which encodes a polypeptide comprising an amino acid sequence that encodes for alpha-glucuronidase. In some embodiments, the nucleic acid is SEQ ID NO:184. In some embodiments, the recombinant yeast host is yeast strain M3222, M3701, M3702, M3703, or M4059.

In some embodiments, the recombinant host cell further comprises a heterologous polynucleotide comprising a nucleic acid which encodes an acetyl esterase. In some embodiments, the nucleic acid which encodes an acetyl esterase encodes a polypeptide comprising an amino acid sequence at least about 90% identical to any one of SEQ ID NOs:223-225. In some embodiments, the nucleic acid which encodes an acetyl esterase encodes a polypeptide comprising an amino acid sequence identical to any one of SEQ ID NOs:223-225.

In some embodiments, the recombinant host cell further comprises a heterologous polynucleotide comprising a nucleic acid which encodes an alpha-glucuronidase. In some embodiments, the nucleic acid which encodes an alpha-glucuronidase encodes a polypeptide comprising an amino acid sequence at least about 90%, 95%, 96%, 97%, 98% or 99% identical to any one of SEQ ID NOs:185-198. In some embodiments, the nucleic acid which encodes an alpha-glucuronidase encodes a polypeptide comprising an amino acid sequence identical to any one of SEQ ID NOs:185-198. In other embodiments, the recombinant host cell further comprises a heterologous polynucleotide comprising a nucleic acid which encodes a beta-glucosidase. In some embodiments, the nucleic acid which encodes a beta-glucosidase encodes a polypeptide comprising an amino acid sequence at least about 90%, 95%, 96%, 97%, 98% or 99% identical to any one of SEQ ID NOs:92, 164-168, 226 and 227. In some embodiments, the nucleic acid which encodes a beta-glucosidase encodes a polypeptide comprising an amino acid sequence identical to any one of SEQ ID NOs: 92, 164-168, 226 and 227.

In some embodiments, the recombinant host cell further comprises a heterologous polynucleotide comprising a nucleic acid which encodes an alpha-galactosidase. In some embodiments, the nucleic acid which encodes an alpha-galactosidase encodes a polypeptide comprising an amino acid sequence at least about 90%, 95%, 96%, 97%, 98% or 99% identical to any one of SEQ ID NOs:108-122. In some embodiments, the nucleic acid which encodes an alpha-galactosidase encodes a polypeptide comprising an amino acid sequence identical to any one of SEQ ID NOs:108-122.

In some embodiments, the recombinant host cell further comprises a heterologous polynucleotide comprising a nucleic acid which encodes a β-mannosidase. In some embodiments, the nucleic acid which encodes the β-mannosidase encodes a polypeptide that is at least about 90%, 95%, 96%, 97%, 98% or 99% identical to a sequence selected from SEQ ID NOs:147-168. In some embodiments, the nucleic acid which encodes the β-mannosidase encodes a polypeptide that is identical to a sequence selected from SEQ ID NOs:147-168.

In other embodiments, the recombinant host cell further comprises a heterologous polynucleotide comprising a nucleic acid which encodes an alpha-galactosidase. In some embodiments, the nucleic acid which encodes an alpha-galactosidase encodes a polypeptide comprising an amino acid sequence at least about 90%, 95%, 96%, 97%, 98% or 99% identical to any one of SEQ ID NOs:108-122. In some embodiments, the nucleic acid which encodes an alpha-galactosidase encodes a polypeptide comprising an amino acid sequence identical to any one of SEQ ID NOs:108-122. In some embodiments, the recombinant host cell further comprises a heterologous polynucleotide comprising a nucleic acid which encodes an endoglucanase. In some embodiments, the nucleic acid which encodes an endoglucanase encodes a polypeptide comprising an amino acid sequence at least about 90%, 95%, 96%, 97%, 98% or 99% identical to any one of SEQ ID NOs:289-345. In some embodiments, the nucleic acid which encodes an endoglucanase encodes a polypeptide comprising an amino acid sequence identical to any one of SEQ ID NOs:289-345.

In some embodiments of the invention, at least one heterologous polynucleotide is expressed by a recombinant yeast host cell. In some embodiments, at least one of the heterologous polynucleotides expresses a polypeptide that is secreted by the recombinant yeast host cell.

In some embodiments of the invention, the recombinant yeast host cell ferments a lignocellulosic material to produce a fermentation product. In some embodiments, the fermentation product is ethanol, lactic acid, hydrogen, butyric acid, acetone, isopropyl alcohol or butanol. In some embodiments, the lignocellulosic material is insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, or agave. In some embodiments the recombinant yeast host cell ferments at least about 20% of xylo-oligomers in the lignocellulosic material. In some embodiments, the recombinant yeast host cell hydrolyzes at least about 50% of xylo-oligomers in the lignocellulosic material to monomers during fermentation of the recombinant yeast host cell. In some embodiments, the recombinant yeast host cell hydrolyzes about 20% to about 80% of xylo-oligomers in the lignocellulosic material to monomers during fermentation of the recombinant yeast host cell.

In some embodiments of the invention, the yeast strain has a specific growth rate ($h^{-1}$) of at least about 0.05 in a culture medium containing xylose as the primary sugar source. In some embodiments, the yeast strain has a specific growth rate ($h^{-1}$) of about 0.05 to about 0.5 in a culture medium containing xylose as the primary sugar source. In some embodiments, the xylose in the culture medium is fermented in about 40 hours or less. In some embodiments, the xylose in the culture medium is at an initial concentration of at least 30 g/L. In some embodiments, fermentation of the recombinant yeast host cell produces an ethanol yield of at least about 15% more ethanol than is produced by a non-recombinant yeast.

In some embodiments of the invention, the recombinant yeast host cell comprising at least one saccharolytic enzyme further comprises a deletion or alteration of one or more glycerol producing enzymes. In some embodiments, the recombinant yeast host cell further comprises a deletion or alteration of GPD1.

One aspect of the invention is directed to a composition comprising a lignocellulosic material and a recombinant yeast host cell comprising as least one saccharolytic enzyme. Another aspect of the invention is directed to a media supernatant generated by incubating a recombinant yeast host comprising as least one saccharolytic enzyme with a medium containing a carbon source. In some embodiments, the carbon source comprises a lignocellulosic material. In some embodiments, the lignocellulosic material is insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, or agave.

Another aspect of the invention is directed to a method of producing a fermentation product comprising: combining a recombinant yeast host cell comprising at least one saccharolytic enzyme with a lignocellulosic material; allowing the recombinant yeast host cell to ferment the lignocellulosic material; and recovering a fermentation product produced by the recombinant yeast host cell. In some embodiments, the lignocellulosic material is insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, or agave. In some embodiments, the fermentation product is ethanol, lactic acid, hydrogen, butyric acid, acetone, or butanol.

In some embodiments, the invention relates to a recombinant yeast host cell comprising a heterologous polynucleotide encoding a polypeptide comprising an amino acid sequence at least about 90%, 95%, 96%, 97%, 98% or 99% identical to any one of the amino acid sequences of SEQ ID NOs:108, 115-122, 146, 155-168, 184, 188-197, 215-225, 227 and 228, or a combination thereof.

One aspect of the invention is directed to a co-culture comprising two or more different recombinant yeast host cells each comprising as least one saccharolytic enzyme. In some embodiments, one of the host cells of the co-culture is a recombinant yeast host cell comprising a heterologous polynucleotide comprising a nucleic acid which encodes a mannanase, a mannosidase, an endoglucanase, a beta-glucosidase, or an acetyl esterase, or a combination thereof. In some embodiments, the heterologous polynucleotide comprises a nucleic acid which encodes a polypeptide comprising an amino acid sequence at least about 90%, 95%, 96%, 97%, 98% or 99% identical to any one of SEQ ID NOs:55, 92, 146, 147, 160-163, 215-230 and 289-345.

In some embodiments, the invention is direct to a co-culture comprising a recombinant host cell comprising at least one saccharolytic enzyme, a recombinant yeast host cell comprising a heterologous polynucleotide comprising a nucleic acid which encodes a mannanase or mannosidase; a recombinant yeast host cell comprising a heterologous polynucleotide comprising a nucleic acid which encodes an endoglucanase; a recombinant yeast host cell comprising a heterologous polynucleotide comprising a nucleic acid which encodes a beta-glucosidase; and a recombinant yeast host cell comprising a heterologous polynucleotide comprising a nucleic acid which encodes an acetyl esterase.

In some embodiments, the invention is directed to a co-culture comprising a recombinant yeast host cell comprising at least one saccharolytic enzyme, a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:146, 147, 160-163, 215-222, and 228-230; a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:54 and 289-345; a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:92, 226, and 227; and a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:223-225.

In some embodiments, the co-culture comprises a recombinant yeast host cell comprising at least one saccharolytic enzyme and further comprises a recombinant yeast host cell comprising a heterologous polynucleotide comprising a nucleic acid which encodes a polypeptide comprising an amino acid sequence identical to SEQ ID NO:146; a recombinant yeast host cell comprising a heterologous polynucleotide comprising a nucleic acid which encodes a polypeptide comprising an amino acid sequence identical to SEQ ID NO:147; a recombinant yeast host cell comprising a heterologous polynucleotide comprising a nucleic acid which encodes a polypeptide comprising an amino acid sequence identical to SEQ ID NO:289; a recombinant yeast host cell comprising a heterologous polynucleotide comprising a nucleic acid which encodes a polypeptide comprising an amino acid sequence identical to SEQ ID NO:226; and a recombinant yeast host cell comprising a heterologous polynucleotide comprising a nucleic acid which encodes a polypeptide comprising an amino acid sequence identical to SEQ ID NO:224.

In some embodiments, the co-culture comprises a recombinant yeast host cell comprising at least one saccharolytic enzyme and further comprises one or more yeast strains selected from M3318, M2295, M3240, M3460, M4494, M5754, M5970, M5891, or any other strain described herein. In some embodiments, the co-culture comprises a recombinant yeast host cell comprising at least one saccharolytic enzyme and the yeast strains M3318, M2295, M3240, M3460, and M4494.

In some embodiments, the invention is directed to an expression vector comprising a polynucleotide comprising a nucleic acid encoded by any one of SEQ ID NOs:347-358, 447-489 or 577-581. In some embodiments, the invention is directed to an expression vector pMU3150, pMU3151, pMU3217, pMU3218, pMU3152, pMU3153, pMU3154, pMU3155, pMU3156, pMU3157, pMU3219, pMU3158, pMU3159, pMU3220, pMU3160, pMU3221, pMU3222, pMU3161, pMU3162, pMU3163, pMU3223, pMU3164, pMU3165, pMU3224, pMU3166, pMU3167, pMU3129, pMU3168, pMU3169, pMU3170, pMU3130, pMU3131, pMU3132, pMU3133, pMU3134, pMU3135, pMU3136, pMU3171, pMU3172, pMU3173, pMU3174, pMU3175, pMU3137, pMU3138, pMU3139, pMU2981, pMU2659, pMU2877, pMU2745, pMU2746, pMU2873 or pMU2879.

In some embodiments, the yeast strain is M3799 or M3059. In some embodiments, the yeast strain is M3222, M3701, M3702, M3703, M4059, M3318, M2295, M3240, M3460, M4494, M4170, M2963, M4042, M4044, M4638, M4642, M4777, M4782, M4821, M4836, M4888, M5401, M5870, M5754, M5891 or M5453. In some embodiments, the yeast strain is transformed with an expression vector comprising a polynucleotide comprising a nucleic acid encoded by any one of SEQ ID NOs:347-358, 447-489 or 577-581. In some embodiments, the yeast strain is transformed with pMU3150, pMU3151, pMU3217, pMU3218, pMU3152, pMU3153, pMU3154, pMU3155, pMU3156, pMU3157, pMU3219, pMU3158, pMU3159, pMU3220, pMU3160, pMU3221, pMU3222, pMU3161, pMU3162, pMU3163, pMU3223, pMU3164, pMU3165, pMU3224, pMU3166, pMU3167, pMU3129, pMU3168, pMU3169, pMU3170, pMU3130, pMU3131, pMU3132, pMU3133, pMU3134, pMU3135, pMU3136, pMU3171, pMU3172, pMU3173, pMU3174, pMU3175, pMU3137, pMU3138, pMU3139, pMU2981, pMU2659, pMU2877, pMU2745, pMU2746, pMU2873 or pMU2879.

In some embodiments, the yeast strain comprises a heterologous polynucleotide encoding a polypeptide comprising an amino acid sequence at least about 90%, 95%, 96%, 97%, 98% or 99% identical to any one of the amino acid sequences of SEQ ID NOs:8, 37, 78, 108, 140, 141, 146, 147, 184, 224, 228, 289, and 346. In some embodiments, the yeast strain comprises heterologous polynucleotides encoding a polypeptides comprising an amino acid sequence at least about 90%, 95%, 96%, 97%, 98% or 99% identical to all of the amino acid sequences of SEQ ID NOs:8, 37, 78, 108, 140, 141, 146, 147, 184, 224, 228, 289, and 346. In some embodiments, the recombinant yeast host cell further comprises a deletion or alteration of one or more glycerol producing enzymes. In some embodiments, the recombinant yeast host cell further comprises a deletion or alteration of GPD1.

In some embodiments, the invention is directed to a composition, comprising an acetylxylanesterase, xylanase, and xylosidase. In some embodiments, the acetylxylanesterase of the composition comprises an amino acid sequence that is at least about 90%, 95%, 96%, 97%, 98% or 99% identical to a sequence selected from SEQ ID NOs:6-10. In some embodiments, the xylanase of the composition comprises an amino acid sequence that is at least about 90%, 95%, 96%, 97%, 98% or 99% identical to a sequence selected from SEQ ID NOs:37-62. In some embodiments, the xylosidase comprises an amino acid sequence that is at least about 90%, 95%, 96%, 97%, 98% or 99% identical to a sequence selected from SEQ ID NOs:78-92. In some embodiments, the composition further comprises a galactosidase. In some embodiments, the galactosidase of the composition comprises an amino acid sequence that is at least about 90%, 95%, 96%, 97%, 98% or 99% identical to a sequence selected from SEQ ID NOs:108-122. In some embodiments, the composition further comprises a mannosidase or mannanase. In some embodiments, the mannosidase or mannanase of the composition comprises an amino acid sequence that is at least about 90%, 95%, 96%, 97%, 98% or 99% identical to a sequence selected from SEQ ID NOs:146-168. In some embodiments, the composition further comprises an alpha-glucuronidase. In some embodiments, the alpha-glucuronidase of the composition comprises an amino acid sequence that is at least about 90%, 95%, 96%, 97%, 98% or 99% identical to a sequence selected from SEQ ID NOs:184-198. In some embodiments, the composition further comprises an acetyl esterase. In some embodiments, the acetyl esterase of the composition comprises an amino acid sequence that is at least about 90%, 95%, 96%, 97%, 98% or 99% identical to a sequence selected from SEQ ID NOs:223-225. In some embodiments, the composition further comprises a glucosidase. In some embodiments, the glucosidase of the composition further comprises an amino acid sequence that is at least about 90%, 95%, 96%, 97%, 98% or 99% identical to a sequence selected from SEQ ID NOs:226-227. In some embodiments, the composition further comprises an endoglucanase. In some embodiments, the endoglucanase of the composition comprises an amino acid sequence that is at least about 90%, 95%, 96%, 97%, 98% or 99% identical to a sequence selected from SEQ ID NOs:289-345. In some embodiments, the composition further comprises a glucuronyl esterase. In some embodiments, the glucuronyl esterase of the composition comprises an amino acid sequence that is at least about 90%, 95%, 96%, 97%, 98% or 99% identical to the sequence of SEQ ID NO:346.

In some embodiments, one or more enzymes in the composition are purified. In some embodiments, the one or more enzymes are purified from a recombinant yeast host cell of the invention, a composition of the invention, a media supernatant of the invention, a co-culture of the invention, or a yeast strain of the invention. In some embodiments, one or more enzymes in the composition are from a crude extract. In some embodiments, the crude extract is from a recombinant yeast host cell of the invention, a composition of the invention, a media supernatant of the invention, a co-culture of the invention, or a yeast strain of the invention.

DETAILED DESCRIPTION OF THE INVENTION

Figure 1:
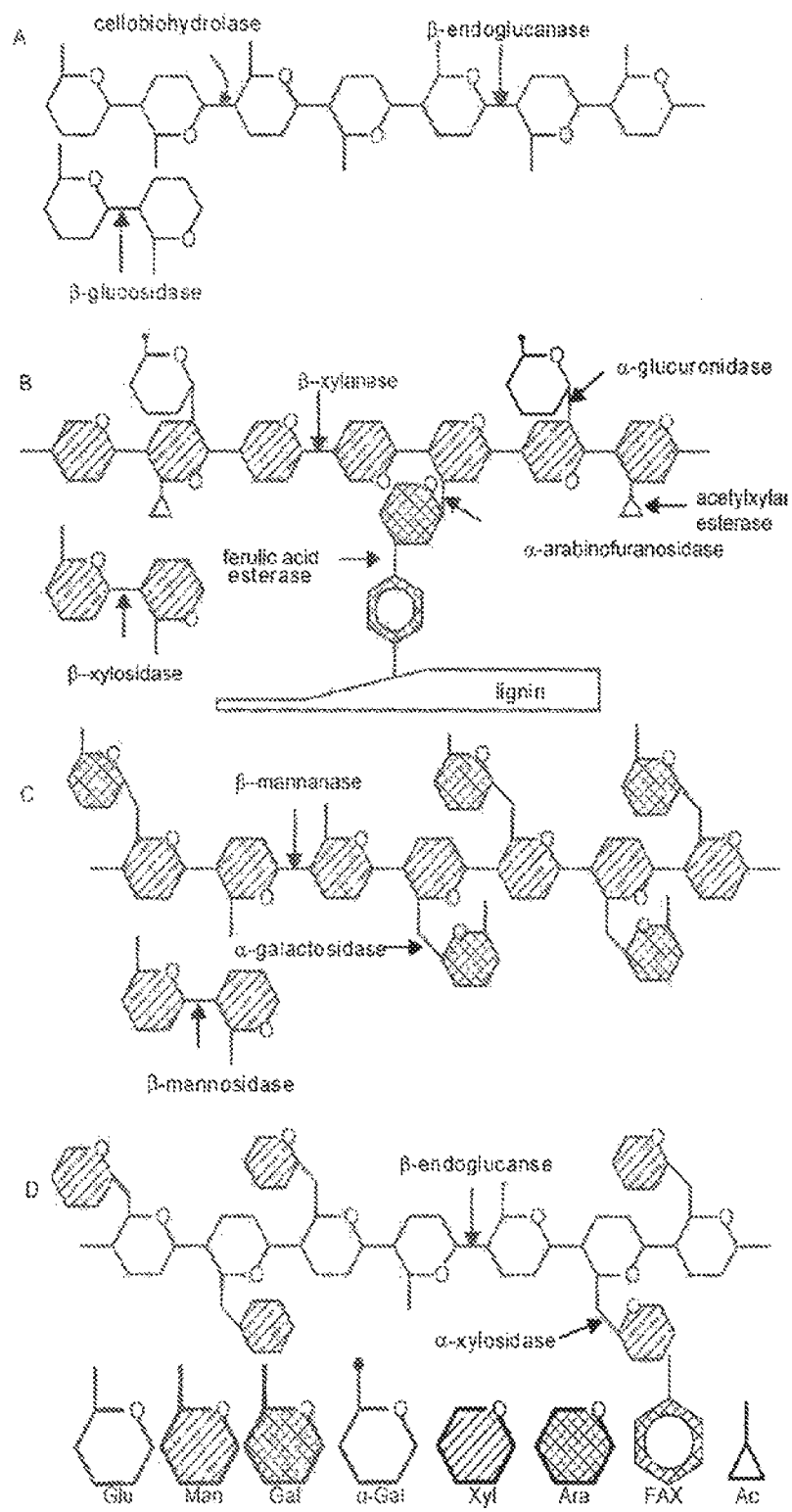
FIGS. 1A-1D depict the complexity of cellulose and hemicellulose and the enzymes involved in their degradation. Cellulose (FIG. 1A) and hemicellulose structures for arabinoxylan (FIG. 1B), galactomannan (FIG. 1C), and xyloglucan (FIG. 1D) are depicted. Hexoses are distinguished from pentoses by the presence of a protruding line from the cyclic hexagon (pyranose ring), depicting the $CH_2OH$ group. Hydrolase enzymes and the bonds targeted for cleavage in the four polysaccharide structures are indicated by arrow.

The disclosed methods and materials are useful generally in the field of engineered yeast.

Definitions

Unless defined otherwise, all technical and scientific terms used herein have the same meaning as commonly understood to one of ordinary skill in the art of microbial metabolic engineering. Although methods and materials similar or equivalent to those described herein can be used in the practice of the disclosed methods and compositions, exemplary methods, devices and materials are described herein.

The embodiment(s) described, and references in the specification to "one embodiment", "an embodiment", "an example embodiment", etc., indicate that the embodiment(s) described can include a particular feature, structure, or characteristic, but every embodiment does not necessarily include the particular feature, structure, or characteristic. Moreover, such phrases are not necessarily referring to the same embodiment. Further, when a particular feature, structure, or characteristic is described in connection with an embodiment, it is understood that it is within the knowledge of one skilled in the art to effect such feature, structure, or characteristic in connection with other embodiments whether or not explicitly described.

The description of "a" or "an" item herein refers to a single item or multiple items. It is understood that wherever embodiments are described herein with the language "comprising," otherwise analogous embodiments described in terms of "consisting of" and/or "consisting essentially of" are also provided. Thus, for example, reference to "a polynucleotide" includes a plurality of such polynucleotides and reference to "the microorganism" includes reference to one or more microorganisms, and so forth.

A "vector," e.g., a "plasmid" or "YAC" (yeast artificial chromosome) refers to an extrachromosomal element often carrying one or more genes that are not part of the central metabolism of the cell, and is usually in the form of a circular double-stranded DNA molecule. Such elements can be autonomously replicating sequences, genome integrating sequences, phage or nucleotide sequences, linear, circular, or supercoiled, of a single- or double-stranded DNA or RNA, derived from any source, in which a number of nucleotide sequences have been joined or recombined into a unique construction which is capable of introducing a promoter fragment and DNA sequence for a selected gene product along with appropriate 3' untranslated sequence into a cell. Preferably, the plasmids or vectors of the present invention are stable and self-replicating.

An "expression vector" is a vector that is capable of directing the expression of genes to which it is operably associated.

The term "integrated" as used herein refers to genetic elements that are placed, through molecular biology techniques, into the genome of a host cell. For example, genetic elements can be placed into the chromosomes of the host cell as opposed to in a vector such as a plasmid carried by the host cell. Methods for integrating genetic elements into the genome of a host cell are well known in the art and include homologous recombination.

The term "heterologous" when used in reference to a polynucleotide, a gene, a polypeptide, or an enzyme refers to a polynucleotide, gene, polypeptide, or an enzyme not normally found in the host organism. "Heterologous" also includes a native coding region, or portion thereof, that is removed from the source organism and subsequently reintroduced into the source organism in a form that is different from the corresponding native gene, e.g., not in its natural location in the organism's genome. The heterologous polynucleotide or gene can be introduced into the host organism by, e.g., gene transfer. A heterologous gene can include a native coding region that is a portion of a chimeric gene including non-native regulatory regions that is reintroduced into the native host. Foreign genes can comprise native genes inserted into a non-native organism, or chimeric genes. A heterologous polynucleotide, gene, polypeptide, or an enzyme can be derived from any source, e.g., eukaryotes, prokaryotes, viruses, or synthetic polynucleotide fragments. The term "heterologous" as used herein also refers to an element of a vector, plasmid or host cell that is derived from a source other than the endogenous source. Thus, for example, a heterologous sequence could be a sequence that is derived from a different gene or plasmid from the same host, from a different strain of host cell, or from an organism of a different taxonomic group (e.g., different kingdom, phylum, class, order, family genus, or species, or any subgroup within one of these classifications). The term "heterologous" is also used synonymously herein with the term "exogenous."

The term "domain" as used herein refers to a part of a molecule or structure that shares common physical or chemical features, for example hydrophobic, polar, globular, helical domains or properties, e.g., a DNA binding domain or an ATP binding domain. Domains can be identified by their homology to conserved structural or functional motifs. Examples of cellobiohydrolase (CBH) domains include the catalytic domain (CD) and the cellulose binding domain (CBD).

A "nucleic acid," "polynucleotide," or "nucleic acid molecule" is a polymeric compound comprised of covalently linked subunits called nucleotides. Nucleic acid includes polyribonucleic acid (RNA) and polydeoxyribonucleic acid (DNA), both of which can be single-stranded or double-stranded. DNA includes cDNA, genomic DNA, synthetic DNA, and semi-synthetic DNA.

An "isolated nucleic acid molecule" or "isolated nucleic acid fragment" refers to the phosphate ester polymeric form of ribonucleosides (adenosine, guanosine, uridine, or cytidine; "RNA molecules") or deoxyribonucleosides (deoxyadenosine, deoxyguanosine, deoxythymidine, or deoxycytidine; "DNA molecules"), or any phosphoester analogs thereof, such as phosphorothioates and thioesters, in either single stranded form, or a double-stranded helix. Double stranded DNA-DNA, DNA-RNA and RNA-RNA helices are possible. The term nucleic acid molecule, and in particular DNA or RNA molecule, refers only to the primary and secondary structure of the molecule, and does not limit it to any particular tertiary forms. Thus, this term includes double-stranded DNA found, inter alia, in linear or circular DNA molecules (e.g., restriction fragments), plasmids, and chromosomes. In discussing the structure of particular double-stranded DNA molecules, sequences are described herein according to the normal convention of giving only the sequence in the 5' to 3' direction along the non-transcribed strand of DNA (i.e., the strand having a sequence homologous to the mRNA).

A "gene" refers to an assembly of nucleotides that encode a polypeptide, and includes cDNA and genomic DNA nucleic acids. "Gene" also refers to a nucleic acid fragment that expresses a specific protein, including intervening sequences (introns) between individual coding segments (exons), as well as regulatory sequences preceding (5' non-coding sequences) and following (3' non-coding sequences) the coding sequence. "Native gene" refers to a gene as found in nature with its own regulatory sequences. The terms "gene(s)" or "polynucleotide" or "nucleic acid" or "polynucleotide sequence(s)" are intended to include nucleic acid molecules, e.g., polynucleotides which include an open reading frame encoding a polypeptide, and can further include non-coding regulatory sequences, and introns. In addition, the terms are intended to include one or more genes that map to a functional locus. Also, the terms are intended to include a specific gene for a selected purpose. The gene can be endogenous to the host cell or can be recombinantly introduced into the host cell, e.g., as a plasmid maintained episomally or a plasmid (or fragment thereof) that is stably integrated into the genome. In addition to the plasmid form, a gene can, for example, be in the form of linear DNA or RNA. The term "gene" is also intended to cover multiple copies of a particular gene, e.g., all of the DNA sequences in a cell encoding a particular gene product.

A nucleic acid molecule is "hybridizable" to another nucleic acid molecule, such as a cDNA, genomic DNA, or RNA, when a single stranded form of the nucleic acid molecule can anneal to the other nucleic acid molecule under the appropriate conditions of temperature and solution ionic strength. Hybridization and washing conditions are well known and exemplified, e.g., in Sambrook, J., Fritsch, E. F. and Maniatis, T. MOLECULAR CLONING: A LABORATORY MANUAL, Second Edition, Cold Spring Harbor Laboratory Press, Cold Spring Harbor (1989), particularly Chapter 11 and Table 11.1 therein (hereinafter "Maniatis", entirely incorporated herein by reference). The conditions of temperature and ionic strength determine the "stringency" of the hybridization. Stringency conditions can be adjusted to screen for moderately similar fragments, such as homologous sequences from distantly related organisms, to highly similar fragments, such as genes that duplicate functional enzymes from closely related organisms. Post-hybridization washes determine stringency conditions. One set of conditions uses a series of washes starting with 6×SSC, 0.5% SDS at room temperature for 15 min, then repeated with 2×SSC, 0.5% SDS at 45° C. for 30 min, and then repeated twice with 0.2×SSC, 0.5% SDS at 50° C. for 30 min. For more stringent conditions, washes are performed at higher temperatures in which the washes are identical to those above except for the temperature of the final two 30 min washes in 0.2×SSC, 0.5% SDS are increased to 60° C. Another set of highly stringent conditions uses two final washes in 0.1×SSC, 0.1% SDS at 65° C. An additional set of highly stringent conditions are defined by hybridization at 0.1×SSC, 0.1% SDS, 65° C. and washed with 2×SSC, 0.1% SDS followed by 0.1×SSC, 0.1% SDS.

Hybridization requires that the two nucleic acids contain complementary sequences, although depending on the stringency of the hybridization, mismatches between bases are possible. The appropriate stringency for hybridizing nucleic acids depends on the length of the nucleic acids and the degree of complementation, variables well known in the art. The greater the degree of similarity or homology between two nucleotide sequences, the greater the value of Tm for hybrids of nucleic acids having those sequences. The relative stability (corresponding to higher Tm) of nucleic acid hybridizations decreases in the following order: RNA:RNA, DNA:RNA, DNA:DNA. For hybrids of greater than 100 nucleotides in length, equations for calculating Tm have been derived (see, e.g., Maniatis at 9.50-9.51). For hybridizations with shorter nucleic acids, i.e., oligonucleotides, the position of mismatches becomes more important, and the length of the oligonucleotide determines its specificity (see, e.g., Maniatis, at 11.7-11.8). In one embodiment the length for a hybridizable nucleic acid is at least about 10 nucleotides. Preferably a minimum length for a hybridizable nucleic acid is at least about 15 nucleotides; more preferably at least about 20 nucleotides; and most preferably the length is at least 30 nucleotides. Furthermore, the skilled artisan will recognize that the temperature and wash solution salt concentration can be adjusted as necessary according to factors such as length of the probe.

The term "percent identity", as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case can be, as determined by the match between strings of such sequences.

As known in the art, "similarity" between two polypeptides is determined by comparing the amino acid sequence and conserved amino acid substitutes thereto of the polypeptide to the sequence of a second polypeptide.

"Identity" and "similarity" can be readily calculated by known methods, including but not limited to those described in: Computational Molecular Biology (Lesk, A. M., ed.) Oxford University Press, NY (1988); Biocomputing: Informatics and Genome Projects (Smith, D. W., ed.) Academic Press, NY (1993); Computer Analysis of Sequence Data, Part I (Griffin, A. M., and Griffin, H. G., eds.) Humana Press, NJ (1994); Sequence Analysis in Molecular Biology (von Heinje, G., ed.) Academic Press (1987); and Sequence Analysis Primer (Gribskov, M. and Devereux, J., eds.) Stockton Press, NY (1991). Preferred methods to determine identity are designed to give the best match between the sequences tested. Methods to determine identity and similarity are codified in publicly available computer programs. Sequence alignments and percent identity calculations can be performed using the Megalign program of the LASERGENE bioinformatics computing suite (DNASTAR Inc., Madison, Wis.). Multiple alignments of the sequences disclosed herein were performed using the Clustal method of alignment (Higgins and Sharp (1989) CABIOS. 5:151-153) with the default parameters (GAP PENALTY=10, GAP LENGTH PENALTY=10). Default parameters for pairwise alignments using the Clustal method were KTUPLE 1, GAP PENALTY=3, WINDOW=5 and DIAGONALS SAVED=5.

Suitable nucleic acid sequences or fragments thereof (isolated polynucleotides of the present invention) encode polypeptides that are at least about 70% to 75% identical to the amino acid sequences reported herein, at least about 80%, 85%, or 90% identical to the amino acid sequences reported herein, or at least about 95%, 96%, 97%, 98%, 99%, or 100% identical to the amino acid sequences reported herein. Suitable nucleic acid fragments are at least about 70%, 75%, or 80% identical to the nucleic acid sequences reported herein, at least about 80%, 85%, or 90% identical to the nucleic acid sequences reported herein, or at least about 95%, 96%, 97%, 98%, 99%, or 100% identical to the nucleic acid sequences reported herein. Suitable nucleic acid fragments not only have the above identities/similarities but typically encode a polypeptide having at least 50 amino acids, at least 100 amino acids, at least 150 amino acids, at least 200 amino acids, or at least 250 amino acids.

A DNA or RNA "coding region" is a DNA or RNA molecule which is transcribed and/or translated into a polypeptide in a cell in vitro or in vivo when placed under the control of appropriate regulatory sequences. "Suitable regulatory regions" refer to nucleic acid regions located upstream (5' non-coding sequences), within, or downstream (3' non-coding sequences) of a coding region, and which influence the transcription, RNA processing or stability, or translation of the associated coding region. Regulatory regions include promoters, translation leader sequences, RNA processing site, effector binding site and stem-loop structure. The boundaries of the coding region are determined by a start codon at the 5' (amino) terminus and a translation stop codon at the 3' (carboxyl) terminus. A coding region can include, but is not limited to, prokaryotic regions, cDNA from mRNA, genomic DNA molecules, synthetic DNA molecules, or RNA molecules. If the coding region is intended for expression in a eukaryotic cell, a polyadenylation signal and transcription termination sequence will usually be located 3' to the coding region.

An "isoform" is a protein that has the same function as another protein but which is encoded by a different gene and can have small differences in its sequence.

A "paralogue" is a protein encoded by a gene related by duplication within a genome.

An "orthologue" is gene from a different species that has evolved from a common ancestral gene by speciation. Normally, orthologues retain the same function in the course of evolution as the ancestral gene.

"Open reading frame" is abbreviated ORF and means a length of nucleic acid, either DNA, cDNA or RNA, that comprises a translation start signal or initiation codon, such as an ATG or AUG, and a termination codon and can be potentially translated into a polypeptide sequence.

"Promoter" refers to a DNA fragment capable of controlling the expression of a coding sequence or functional RNA. In general, a coding region is located 3' to a promoter. Promoters can be derived in their entirety from a native gene, or be composed of different elements derived from different promoters found in nature, or even comprise synthetic DNA segments. It is understood by those skilled in the art that different promoters can direct the expression of a gene in different tissues or cell types, or at different stages of development, or in response to different environmental or physiological conditions. Promoters which cause a gene to be expressed in most cell types at most times are commonly referred to as "constitutive promoters". It is further recognized that since in most cases the exact boundaries of regulatory sequences have not been completely defined, DNA fragments of different lengths can have identical promoter activity. A promoter is generally bounded at its 3' terminus by the transcription initiation site and extends upstream (5' direction) to include the minimum number of bases or elements necessary to initiate transcription at levels detectable above background. Within the promoter will be found a transcription initiation site (conveniently defined for example, by mapping with nuclease S1), as well as protein binding domains (consensus sequences) responsible for the binding of RNA polymerase.

A coding region is "under the control" of transcriptional and translational control elements in a cell when RNA polymerase transcribes the coding region into mRNA, which is then trans-RNA spliced (if the coding region contains introns) and translated into the protein encoded by the coding region.

"Transcriptional and translational control regions" are DNA regulatory regions, such as promoters, enhancers, terminators, and the like, that provide for the expression of a coding region in a host cell. In eukaryotic cells, polyadenylation signals are control regions.

The term "operably associated" refers to the association of nucleic acid sequences on a single nucleic acid fragment so that the function of one is affected by the other. For example, a promoter is operably associated with a coding region when it is capable of affecting the expression of that coding region (i.e., that the coding region is under the transcriptional control of the promoter). Coding regions can be operably associated to regulatory regions in sense or antisense orientation.

The term "expression," as used herein, refers to the transcription and stable accumulation of sense (mRNA) or antisense RNA derived from the nucleic acid fragment of the invention. Expression can also refer to translation of mRNA into a polypeptide.

The term "yield" is defined as the amount of product obtained per unit weight of raw material and can be expressed as gram product per gram substrate (g/g). Yield can also be expressed as a percentage of the theoretical yield. "Theoretical yield" is defined as the maximum amount of product that can be generated (e.g., ethanol or monomer sugar) per a given amount of substrate, as dictated by the stoichiometry of the metabolic pathway used to make the product (e.g., hydrolysis and fermentation of oligomers). The theoretical yield for one typical conversion of glucose to ethanol is 0.51 g EtOH per 1 g glucose. As such, a yield of 4.8 g ethanol from 10 g of glucose can be expressed as 94% of theoretical or 94% theoretical yield. The terms "theoretical hydrolysis" and "theoretical hydrolysis yield" are used interchangeably and defined as the fraction of an observed amount of monomer sugar actually released by hydrolysis of an oligomer sugar compared to the maximum amount of monomer sugar that could be released by hydrolysis of an oligomer sugar.

The term "lignocellulose" refers to material that is comprised of lignin and cellulose. Examples of lignocelluloses are provided herein and are known in the art.

A "cellulolytic enzyme" can be any enzyme involved in cellulose digestion, metabolism and/or hydrolysis. The term "cellulase" refers to a class of enzymes produced chiefly by fungi, bacteria, and protozoans that catalyze cellulolysis (i.e., the hydrolysis) of cellulose. However, there are also cellulases produced by other types of organisms such as plants and animals. Several different kinds of cellulases are known, which differ structurally and mechanistically. There are general types of cellulases based on the type of reaction catalyzed: endocellulase breaks internal bonds to disrupt the crystalline structure of cellulose and expose individual cellulose polysaccharide chains; exocellulase cleaves 2-4 units from the ends of the exposed chains produced by endocellulase, resulting in the tetrasaccharides or disaccharide such as cellobiose. There are two main types of exocellulases (or cellobiohydrolases, abbreviated CBH)—one type working processively from the reducing end, and one type working processively from the non-reducing end of cellulose; cellobiase or beta-glucosidase hydrolyses the exocellulase product into individual monosaccharides; oxidative cellulases that depolymerize cellulose by radical reactions, as for instance cellobiose dehydrogenase (acceptor); cellulose phosphorylases that depolymerize cellulose using phosphates instead of water. In the most familiar case of cellulase activity, the enzyme complex breaks down cellulose to beta-glucose. A "cellulase" can be any enzyme involved in cellulose digestion, metabolism and/or hydrolysis, including an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, acetyl esterase, arabinofuranohydrolase, swollenin, glucuronyl esterase, expansin, pectinase, and feruoyl esterase protein.

The term "xylanolytic activity" is intended to include the ability to hydrolyze glycosidic linkages in oligopentoses and polypentoses. The term "xylanase" is the name given to a class of enzymes which degrade the linear polysaccharide beta-1,4-xylan into xylose, thus breaking down hemicellulose, one of the major components of plant cell walls. As such, it plays a major role in micro-organisms thriving on plant sources (mammals, conversely, do not produce xylanase). Additionally, xylanases are present in fungi for the degradation of plant matter into usable nutrients. Xylanases include those enzymes that correspond to Enzyme Commission Number 3.2.1.8. A "xylose metabolizing enzyme" can be any enzyme involved in xylose digestion, metabolism and/or hydrolysis, including a xylose isomerase, xylulokinase, xylose reductase, xylose dehydrogenase, xylitol dehydrogenase, xylonate dehydratase, xylose transketolase, and a xylose transaldolase protein.

The term "xylosidase" is the name given to a class of enzymes which hydrolyze O-glycosyl bonds. Xylosidases include, for example, those enzymes that correspond to Enzyme Commission Number 3.2.1.37.

The term "xylanase" is the name given to a class of enzymes which break down beta-1,4-xylan to form xylose. Xylanases include, for example, those enzymes that correspond to Enzyme Commission Number 3.2.1.8. Xylanases include, for example, "β-xylanase".

The terms "acetylxylanesterase" or "AXE" are the names given to a class of enzymes which catalyze the deacetylation of xylans and xylo-oligosaccharides. Acetylxylanesterases include, for example, those enzymes that correspond to Enzyme Commission Number 3.2.1.72.

The terms "acetyl esterase" or "AE" are the names given to a class of enzymes which catalyze the formation of an alcohol and acetate from an acetic ester. Acetyl esterases include, for example, those enzymes that correspond to Enzyme Commission Number 3.1.1.6.

The term "galactosidase" is the name given to a class of enzymes which catalyze the hydrolysis and cleavage of terminal galactose residues. Galactosidases include "β-galactosidase" which catalyzes the hydrolysis of β-galactosides to form monosaccharides and "α-galactosidase" which catalyzes the hydrolysis of alpha-galactosides to form monosaccharides, such as those found in biomass. Galactosidases include, for example, those enzymes that correspond to Enzyme Commission Numbers 3.2.1.22 and 3.2.1.23.

The term "glucuronidase" is the name given to a class of enzymes which catalyze the hydrolysis of glucuronides. Glucuronidases include, for example, those enzymes that correspond to Enzyme Commission Numbers 3.2.1.131 and 3.2.1.139. Glucuronidases include, for example, "alpha-glucuronidase" or "α-glucuronidase" which catalyzes the hydrolysis of alpha-D-glucuronoside to form alcohol and D-glucuronate.

The terms "Beta-glucosidase" or "β-glucosidase" are the names given to a class of enzymes which catalyze the hydrolysis of the terminal non-reducing residues in beta-D-glucosides. Beta-glucosidases include, for example, those enzymes that correspond to Enzyme Commission Number 3.2.1.21.

The term "endoglucanase" is the name given to a class of enzymes which cut at random in the cellulose polysaccharide chain of amorphous cellulose, generating oligosaccharides of varying lengths and consequently new chain ends. Endoglucanases include, for example, those enzymes that correspond to Enzyme Commission Number 3.2.1.4.

The terms "mannosidase" and "mannanase" are the names given to a class of enzymes which catalyze the hydrolysis of mannan to mannose. These include, for example, those enzymes that correspond to Enzyme Commission Numbers 3.2.1.78 and 3.2.1.25. Mannosidases include, for example, "alpha-mannosidase" and "beta-mannosidase". The term "pectinase" is a general term for enzymes, such as pectolyase, pectozyme, and polygalacturonase, commonly referred to in brewing as pectic enzymes. These enzymes break down pectin, a polysaccharide substrate that is found in the cell walls of plants. One of the most studied and widely used commercial pectinases is polygalacturonase. Pectinases are commonly used in processes involving the degradation of plant materials, such as speeding up the extraction of fruit juice from fruit, including apples and sapota. Pectinases have also been used in wine production since the 1960s.

A "saccharolytic enzyme" can be any enzyme involved in carbohydrate digestion, metabolism and/or hydrolysis, including amylases, cellulases, hemicellulases, cellulolytic, and amylolytic accessory enzymes, inulinases, levanases, and pentose sugar utilizing enzymes.

A "pentose sugar utilizing enzyme" can be any enzyme involved in pentose sugar digestion, metabolism and/or hydrolysis, including xylanase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

As used herein, the term "anaerobic" refers to an organism, biochemical reaction, or process that is active or occurs under conditions of an absence of gaseous $O_2$.

"Anaerobic conditions" are defined as conditions under which the oxygen concentration in the fermentation medium is too low for the microorganism to use it as a terminal electron acceptor. Anaerobic conditions can be achieved by sparging a fermentation medium with an inert gas such as nitrogen until oxygen is no longer available to the microorganism as a terminal electron acceptor. Alternatively, anaerobic conditions can be achieved by the microorganism consuming the available oxygen of fermentation until oxygen is unavailable to the microorganism as a terminal electron acceptor.

"Aerobic metabolism" refers to a biochemical process in which oxygen is used as a terminal electron acceptor to convert energy, typically in the form of ATP, from carbohydrates. Aerobic metabolism typically occurs, for example, via the electron transport chain in mitochondria in eukaryotes, wherein a single glucose molecule is metabolized completely into carbon dioxide in the presence of oxygen.

In contrast, "anaerobic metabolism" refers to a biochemical process in which oxygen is not the final acceptor of electrons generated. Anaerobic metabolism can be divided into anaerobic respiration, in which compounds other than oxygen serve as the terminal electron acceptor, and substrate level phosphorylation, in which no exogenous electron acceptor is used and products of an intermediate oxidation state are generated via a "fermentative pathway."

In "fermentative pathways", the amount of NAD(P)H generated by glycolysis is balanced by the consumption of the same amount of NAD(P)H in subsequent steps. For example, in one of the fermentative pathways of certain yeast strains, NAD(P)H generated through glycolysis donates its electrons to acetaldehyde, yielding ethanol. Fermentative pathways are usually active under anaerobic conditions but can also occur under aerobic conditions, under conditions where NADH is not fully oxidized via the respiratory chain.

As used herein, the term "end-product" refers to a chemical compound that is not or cannot be used by a cell, and so is excreted or allowed to diffuse into the extracellular environment. Common examples of end-products from anaerobic fermentation include, but are not limited to, ethanol, acetic acid, formic acid, lactic acid, hydrogen, and carbon dioxide.

As used herein, "cofactors" are compounds involved in biochemical reactions that are recycled within the cells and remain at approximately steady state levels. Common examples of cofactors involved in anaerobic fermentation include, but are not limited to, $NAD^+$ and $NADP^+$. In metabolism, a cofactor can act in oxidation-reduction reactions to accept or donate electrons. When organic compounds are broken down by oxidation in metabolism, their energy can be transferred to $NAD^+$ by its reduction to NADH, to $NADP^+$ by its reduction to NADPH, or to another cofactor, $FAD^+$, by its reduction to $FADH_2$. The reduced cofactors can then be used as a substrate for a reductase.

As used herein, a "pathway" is a group of biochemical reactions that together can convert one compound into another compound in a step-wise process. A product of the first step in a pathway can be a substrate for the second step, and a product of the second step can be a substrate for the third, and so on. Pathways of the present invention include, but are not limited to, the pyruvate metabolism pathway, the lactate production pathway, the ethanol production pathway, and the glycerol production pathway.

The term "recombination" or "recombinant" refers to the physical exchange of DNA between two identical (homologous), or nearly identical, DNA molecules. Recombination can be used for targeted gene deletion or to modify the sequence of a gene. The terms "recombinant microorganism" and "recombinant host cell" are used interchangeably herein and refer to microorganisms that have been genetically modified to express or over-express endogenous polynucleotides, or to express heterologous polynucleotides, such as those included in a vector, or which have a modification in expression of an endogenous gene.

By "expression modification" it is meant that the expression of the gene, or level of a RNA molecule or equivalent RNA molecules encoding one or more polypeptides or polypeptide subunits, or activity of one or more polypeptides or polypeptide subunits is up regulated or down-regulated, such that expression, level, or activity, is greater than or less than that observed in the absence of the modification.

In one aspect of the invention, genes or particular polynucleotide sequences are partially, substantially, or completely deleted, silenced, inactivated, or down-regulated in order to inactivate the enzymatic activity they encode. Complete deletions provide maximum stability because there is no opportunity for a reverse mutation to restore function. Alternatively, genes can be partially, substantially, or completely deleted, silenced, inactivated, or down-regulated by insertion, deletion, removal, or substitution of nucleic acid sequences that disrupt the function and/or expression of the gene.

Host Cells Expressing Heterologous Saccharolytic Enzymes

In order to address the limitations of the previous systems, in one aspect, the present invention provides host cells expressing heterologous cellulases that can be effectively and efficiently utilized to produce products such as ethanol from cellulose. In some embodiments, the host cells express heterologous enzymes that utilize pentose sugars.

In some embodiments, the host cell can be a yeast. According to the present invention the yeast host cell can be, for example, from the genera *Saccharomyces, Kluyveromyces, Candida, Pichia, Schizosaccharomyces, Hansenula, Kloeckera, Schwanniomyces*, or *Yarrowia*. Yeast species of host cells can include, for example, *S. cerevisiae, S. bulderi, S. barnetti, S. exiguus, S. uvarum, S. diastaticus, K. lactis, K. marxianus*, or *K. fragilis*. In some embodiments, the yeast is selected from *Saccharomyces cerevisiae, Schizosaccharomyces pombe, Candida albicans, Pichia pastoris, Pichia stipitis, Yarrowia lipolytica, Hansenula polymorpha, Phaffia rhodozyma, Candida utilis, Arxula adeninivorans, Debaryomyces hansenii, Debaryomyces polymorphus, Schizosaccharomyces pombe* or *Schwanniomyces occidentalis*. In some embodiments, the yeast is *Saccharomyces cerevisiae*. The selection of an appropriate host is deemed to be within the scope of those skilled in the art from the teachings herein.

In some embodiments of the present invention, the host cell is an oleaginous cell. According to the present invention, the oleaginous host cell can be an oleaginous yeast cell. For example, the oleaginous yeast host cell can be from the genera *Blakeslea, Candida, Cryptococcus, Cunninghamella, Lipomyces, Mortierella, Mucor, Phycomyces, Pythium, Rhodosporidum, Rhodotorula, Trichosporon,* or *Yarrowia*. In some embodiments, the oleaginous host cell can be an oleaginous microalgae host cell. For example, the oleaginous microalgae host cell can be from the genera *Thraustochytrium* or *Schizochytrium*.

In some embodiments of the present invention, the host cell is a thermotolerant host cell. Thermotolerant host cells are useful in simultaneous saccharification and fermentation processes by allowing externally produced cellulases and ethanol-producing host cells to perform optimally in similar temperature ranges. Thermotolerant host cells of the invention can include, for example, *Issatchenkia orientalis, Pichia mississippiensis, Pichia mexicana, Pichia farinosa, Clavispora opuntiae, Clavispora lusitaniae, Candida mexicana, Hansenula polymorpha* and *Kluyveromyces* host cells.

In some embodiments of the present invention, the host cell is a *Kluyveromyces* host cell. For example, the *Kluyveromyces* host cell can be a *K. lactis, K. marxianus, K. blattae, K. phaffii, K. yarrowii, K. aestuarii, K. dobzhanskii, K. wickerhamii, K. thermotolerans*, or *K. waltii* host cell. In some embodiments, the host cell is a *K. lactis* or *K. marxianus* host cell. In other embodiments, the host cell is a *K. marxianus* host cell.

In some embodiments of the present invention, the thermotolerant host cell can grow at temperatures above about 30° C., about 31° C., about 32° C., about 33° C., about 34° C., about 35° C., about 36° C., about 37° C., about 38° C., about 39° C., about 40° C., about 41° C., about 42° C., or any range of values thereof. In some embodiments of the present invention, the thermotolerant host cell can produce ethanol from cellulose at temperatures above about 30° C., about 31° C., about 32° C., about 33° C., about 34° C., about 35° C., about 36° C., about 37° C., about 38° C., about 39° C., about 40° C., about 41° C., about 42° C., about 50° C., or any range of values thereof.

In some embodiments of the present invention, the thermotolerant host cell can grow at temperatures from, for example, about 30° C. to about 60° C., about 30° C. to about 55° C., about 30° C. to about 50° C., about 40° C. to about 60° C., about 40° C. to about 55° C., or about 40° C. to about 50° C. In some embodiments of the present invention, the thermotolerant host cell can produce ethanol from cellulose at temperatures from about 30° C. to about 60° C., about 30° C. to about 55° C., about 30° C. to about 50° C., about 40° C. to about 60° C., about 40° C. to about 55° C., or about 40° C. to about 50° C.

Host cells of the invention are genetically engineered (e.g., transduced, transformed, or transfected) with the polynucleotides encoding saccharolytic enzymes (e.g., amylases, cellulases, hemicellulases, cellulolytic and amylolytic accessory enzymes, inulinases, levanases, pentose sugar hydrolases, acetylxylanesterases, xylanases, xylosidases, galactosidases, mannosidases, mannanases, alpha-glucuronidases, endoglucanases, beta-glucosidases, acetyl esterases, and others) of this invention which are described in more detail herein. The polynucleotides encoding saccharolytic enzymes can be introduced to the host cell on a vector of the invention, which can be, for example, a cloning vector or an expression vector comprising a sequence encoding a heterologous saccharolytic enzyme. The host cells can comprise polynucleotides of the invention as integrated copies or plasmid copies.

In certain aspects, the present invention relates to host cells containing the polynucleotide constructs described herein. In some embodiments, the host cells of the present invention express one or more heterologous polypeptides of saccharolytic enzymes. In some embodiments, the host cell comprises a combination of polynucleotides that encode heterologous saccharolytic enzymes or fragments, variants, or derivatives thereof. The host cell can, for example, comprise multiple copies of the same nucleic acid sequence, for example, to increase expression levels, or the host cell can comprise a combination of unique polynucleotides. In other embodiments, the host cell comprises a single polynucleotide that encodes a heterologous saccharolytic enzyme or a fragment, variant, or derivative thereof. In particular, such host cells expressing a single heterologous saccharolytic enzyme can be used in co-culture with other host cells of the invention comprising a polynucleotide that encodes at least one other heterologous saccharolytic enzyme or fragment, variant, or derivative thereof.

In some embodiments, the host cell expresses at least one, at least two, at least three, at least four, at least five, at leave six, at least seven, at least eight, at least nine, at least 10, at least 11, at least 12, at least 13, at least 14, at least 15, at least 16, at least 17, at least 18, at least 19, or at least 20 saccharolytic enzymes. In some embodiments, the host cell expresses an acetylxylanesterase. In some embodiments, the acetylxylanesterase is selected from SEQ ID NOs:6-10. In some embodiments, the host cell expresses a xylanase. In some embodiments, the xylanase is selected from SEQ ID NOs:37-62. In some embodiments, the host cell expresses a xylosidase. In some embodiments, the xylosidase is selected from SEQ ID NOs:78-92. In some embodiments, the host cell expresses a galactosidase. In some embodiments, the galactosidase is selected from SEQ ID NOs:108-122. In some embodiments, the host cell expresses a mannosidase. In some embodiments, the mannosidase is selected from SEQ ID NOs:146-168. In some embodiments, the host cell expresses an alpha-glucuronidase. In some embodiments, the alpha-glucuronidase is selected from SEQ ID NOs:184-198. In some embodiments, the host cell comprises one or more saccharolytic enzymes selected from SEQ ID NOs:8, 37, 78, 108, 140, 141, 146, 147, 184, 224, 228, 289, and 346. In some embodiments, the host cell comprises one or more saccharolytic enzymes selected from SEQ ID NOs:8, 37, 78, 108, 140, 141, 146, 147, 184, 224, 228, 289, and 346.

Introduction of a polynucleotide encoding a heterologous saccharolytic enzyme into a host cell can be done by methods known in the art. Introduction of polynucleotides encoding a heterologous saccharolytic enzyme into, for example, yeast host cells, can be effected by lithium acetate transformation, spheroplast transformation, or transformation by electroporation, as described in Current Protocols in Molecular Biology, 13.7.1-13.7.10. Introduction of the construct can also be effected by calcium phosphate transfection, DEAE-Dextran mediated transfection, or electroporation. (Davis, L., et al., Basic Methods in Molecular Biology, (1986)).

Transformed host cells or cultures of the invention can be examined for protein content of an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase protein, alpha-amylase, beta-amylase, glucoamylase, pullulanase, isopullulanase, alpha-glucosidase, beta-glucosidase, arabinase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase. For the use of secreted heterologous saccharolytic enzymes, protein content can be determined by analyzing the host (e.g., yeast) cell supernatants. In some embodiments, high molecular weight material can be recovered from the yeast cell supernatant either by acetone precipitation or by buffering the samples with disposable de-salting cartridges. Proteins, including tethered heterologous saccharolytic enzymes, can also be recovered and purified from recombinant host cell or cultures of the invention by spheroplast preparation and lysis, cell disruption using glass beads, or cell disruption using liquid nitrogen, for example. Additional protein purification methods include, for example, ammonium sulfate or ethanol precipitation, acid extraction, anion or cation exchange chromatography, phosphocellulose chromatography, hydrophobic interaction chromatography, affinity chromatography, hydroxylapatite chromatography, gel filtration, and lectin chromatography. Protein refolding steps can be used, as necessary, in completing configuration of the mature protein. Finally, high performance liquid chromatography (HPLC) can be employed for final purification steps.

Protein analysis methods include, for example, methods such as the traditional Lowry method, the BCA assay, absorbance at 280 nm, or the protein assay method according to BioRad's manufacturer's protocol. Using such methods, the protein content of saccharolytic enzymes can be estimated. Additionally, to accurately measure protein concentration, a heterologous cellulase can be expressed with a tag, for example a histidine (His)-tag or hemagglutinin (HA)-tag and purified by standard methods using, for example, antibodies against the tag, a standard nickel resin purification technique, or similar approach.

Transformed host cells or cell cultures of the invention, as described above, can be further analyzed for hydrolysis of cellulose, or starch, or pentose sugar utilization (e.g., by a sugar detection assay), for a particular type of saccharolytic enzyme activity (e.g., by measuring the individual endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase) or for total cellulase activity. Endoglucanase activity can be determined, for example, by measuring an increase of reducing ends in an endoglucanase specific CMC or hydroxyethylcellulose (HEC) substrate. Cellobiohydrolase activity can be measured, for example, by using insoluble cellulosic substrates such as the amorphous substrate phosphoric acid swollen cellulose (PASC) or microcrystalline cellulose (Avicel) and determining the extent of the substrate's hydrolysis. β-glucosidase activity can be measured by a variety of assays, e.g., using cellobiose. Assays for activity of other saccharolytic enzyme types are known in the art and are exemplified below.

A total saccharolytic enzyme activity, which can include the activity of endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase protein, alpha-amylase, beta-amylase, glucoamylase, alpha-glucosidase, beta-glucosidase, galactosidase, arabinase, arabinoxylanase, arabinosidase, arabinofuranosidase, arabinoxylanase, arabinosidase, pullulanase, isopullulanase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase can hydrolyze biomass feedstocks synergistically. For example, total cellulase activity can thus be measured using insoluble substrates including pure cellulosic substrates such as Whatman No. 1 filter paper, cotton linter, microcrystalline cellulose, bacterial cellulose, algal cellulose, and cellulose-containing substrates such as dyed cellulose, alpha-cellulose, or pretreated lignocellulose. Specific activity of cellulases can also be detected by methods known to one of ordinary skill in the art, such as by the Avicel assay (described supra) that would be normalized by protein (cellulase) concentration measured for the sample. Total saccharolytic activity could be also measured using complex substrate containing starch, cellulose and hemicellulose, such as corn mash by measuring released monomeric sugars. In such an assay, different groups of enzymes could work in "indirect" when one group of enzymes such as cellulases can make substrate for another group of enzymes such as amylases more accessible through hydrolysis of cellulolytic substrate around amylolytic substrate. This mechanism can also work vice versa.

One aspect of the invention is thus related to the efficient production of saccharolytic enzymes to aid in the digestion and utilization of starch, cellulose, and pentose sugars, and generation of products such as ethanol. A "saccharolytic enzyme" can be any enzyme involved in carbohydrate digestion, metabolism and/or hydrolysis, including amylases, cellulases, hemicellulases, cellulolytic, and amylolytic accessory enzymes, inulinases, levanases, and pentose sugar hydrolyzing enzymes. A "cellulase" can be any enzyme involved in cellulase digestion, metabolism and/or hydrolysis, including, for example, an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase protein. An "amylase" can be any enzyme involved in amylase digestion and/or metabolism, including alpha-amylase, beta-amylase, glucoamylase, pullulanase, isopullulanase, and alpha-glucosidase. A pentose sugar hydrolyzing enzyme can be any enzyme involved in pentose sugar digestion, and/or metabolism, including, for example, xylanase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

In additional embodiments, the transformed host cells or cell cultures can be assayed for ethanol production. Ethanol production can be measured by techniques known to one of ordinary skill in the art, e.g., by a standard HPLC refractive index method.

In some embodiments, the yeast host cell is selected from the following strains M3799, M3059, M3222, M3701, M3702, M3703, M4059, M3318, M2295, M3240, M3460, M4494, M4170, M2963, M4042, M4044, M4638, M4642, M4777, M4782, M4821, M4836, M4888, M5401, M5870, M5754, M5891 or M5453.

*Saccharomyces cerevisiae* strain M3799, an adapted strain that utilizes xylose and generated by the methods described in Example 1, was deposited with the American Type Culture Collection (ATCC), 10801 University Boulevard, Manassas, Va., 20110 on Aug. 30, 2012, and assigned ATCC Accession No. PTA-13180.

Heterologous Saccharolytic Enzymes

According to one aspect of the present invention, the expression of heterologous saccharolytic enzymes in a host cell can be used advantageously to produce products such as ethanol from biomass sources. For example, cellulases from a variety of sources can be heterologously expressed to successfully increase efficiency of ethanol production. The saccharolytic enzymes can be from fungi, yeast, bacteria, plant, protozoan, or termite sources. In some embodiments, the saccharolytic enzyme is from *Aspergillus niger, Trichoderma reesei, Neosartorya fischeri, Chaetomium thermophilum, Chrysosporium lucknowense, Aureobasidium pullulans, Clostridium phytofermentans, Anaerocellum thermophilum, Pyrenophora tritici-repentis, Aspergillus nidulans, Cochliobolus carbonum, Penicillium herquei, Pyrenophora tritici-repentis, Clostridium stercorarium, Talaromyces stipitatus* GH31, *Metarhizium acridum* CQMa 102, *Pyrenophora teres* f. *teres* 0-1, *Talaromyces emersonii, Aspergillus aculeatus, Saccharophagus degradans* 2-40, *Anaerocellum thermophilum, Scheffersomyces stipitis, Aspergillus clavatus, Debaryomyces hansenii, Scheffersomyces stipitis, Pyrenophora tritici-repentis, Aspergillus fumigatus, Chaetomium globosum, Arabidopsis thaliana,*

*Hordeum vulgare, Oncidium Gower Ramsey, Zea Mays, Oryza sativa, Aspergillus oryzae, Schizophyllum commune, Neurospora crassa, Fusarium sporotrichioides, Pichia stipitus, Humicola insolens, Podspora anserine, Tetrahymena thermophilum, Polysphondylium pallidum, Dictyostelium fasciculatum, Saccharomycopsis fibuligera, Aspergillus terreus, Trichoderma longibrachiatum, Penicillium marneffei, Thielavia heterothallica, Fusarium oxysporum, Magnaporthe grisea, Fusarium graminearum, Hypocrea jecorina, Chrysosporium lucknowense, Polyporus arcularius, Aspergillus kawachii, Heterodera schachtii, Orpinomyces sp., Irpex lacteus, Penicillium decumbens, Phanerochaete chrysosporium, Stachybotrys echinata, Chaetomium brasiliense, Thielavia terrestris, Streptomyces avermitilis, Saccharophagus degradans 2-40, Bacillus subtilis, Clostridium phytofermentans, Clostridium cellulolyticum, Thermobifida fusca, Clostridium thermocellum, Clostridium stercorarium, Anaerocellum thermophilum,* or *Thermobifida fusca.*

In some embodiments of the invention, multiple saccharolytic enzymes from a single organism are co-expressed in the same host cell. In some embodiments of the invention, multiple saccharolytic enzymes from different organisms are co-expressed in the same host cell. In particular, saccharolytic enzymes from two, three, four, five, six, seven, eight, nine or more organisms can be co-expressed in the same host cell. Similarly, the invention can encompass co-cultures of yeast strains, wherein the yeast strains express different saccharolytic enzymes. Co-cultures can include yeast strains expressing heterologous saccharolytic enzymes from the same organisms or from different organisms. Co-cultures can include yeast strains expressing saccharolytic enzymes from two, three, four, five, six, seven, eight, nine or more organisms.

Lignocellulases of the present invention include both endoglucanases and exoglucanases. Other lignocellulases of the invention include accessory enzymes which can act on the lignocellulosic material. The lignocellulases can be, for example, endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, and feruoyl esterases. In some embodiments, the lignocellulases of the invention can be any suitable enzyme for digesting the desired lignocellulosic material.

In some embodiments of the invention, the lignocellulase can be an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, and feruoyl esterase paralogue or orthologue.

In some embodiments, the saccharolytic enzyme of the invention comprises an amino acid sequence or is encoded by a polynucleotide sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs: 1-346, or any range of values thereof. In some embodiments, the saccharolytic enzyme is an acetylxylanesterase. In some embodiments, the acetylxylanesterase is selected from SEQ ID NOs:6-10. In some embodiments, the saccharolytic enzyme is a xylanase. In some embodiments, the xylanase is selected from SEQ ID NOs:37-62. In some embodiments, the saccharolytic enzyme is a xylosidase. In some embodiments, the xylosidase is selected from SEQ ID NOs:78-92. In some embodiments, the saccharolytic enzyme is a galactosidase. In some embodiments, the galactosidase is selected from SEQ ID NOs:108-122. In some embodiments, the saccharolytic enzyme is a mannosidase. In some embodiments, the mannosidase is selected from SEQ ID NOs:146-168. In some embodiments, the saccharolytic enzyme is an alpha-glucuronidase. In some embodiments, the alpha-glucuronidase is selected from SEQ ID NOs:184-198. In some embodiments, the saccharolytic enzymes are selected from SEQ ID NOs:8, 37, 78, 108, 140, 141, 146, 147, 184, 224, 228, 289, and 346. In some embodiments, the saccharolytic enzymes are selected from SEQ ID NOs:8, 37, 78, 108, 140, 141, 146, 147, 184, 224, 228, 289, and 346. In some embodiments, the saccharolytic enzyme comprises a tag, such as, for example, a histidine tag.

In some embodiments, the invention is directed to a composition comprising one or more saccharolytic enzymes described herein. In some embodiments, the composition comprises an acetylxylanesterase, xylanase, and xylosidase. In some embodiments, the acetylxylanesterase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:6-10, or any range of values thereof. In some embodiments, the xylanase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:37-62, or any range of values thereof. In some embodiments, the xylosidase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:78-92, or any range of values thereof.

In some embodiments, the composition further comprises a galactosidase. In some embodiments, the galactosidase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:108-122, or any range of values thereof.

In some embodiments, the composition further comprises a mannosidase or mannanase. In some embodiments, the mannosidase or mannanase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:146-168, or any range of values thereof.

In some embodiments, the composition further comprises an alpha-glucuronidase. In some embodiments, the alpha-glucuronidase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:184-198, or any range of values thereof.

In some embodiments, the composition further comprises an acetyl esterase. In some embodiments, the acetyl esterase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:223-225, or any range of values thereof.

In some embodiments, the composition further comprises a glucosidase. In some embodiments, the glucosidase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs: 226-227, or any range of values thereof.

In some embodiments, the composition further comprises an endoglucanase. In some embodiments, the endoglucanase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to a sequence selected from SEQ ID NOs:289-345, or any range of values thereof.

In some embodiments, the composition further comprises a glucuronyl esterase. In some embodiments, the glucuronyl esterase comprises an amino acid sequence that is at least about 70%, at least about 75%, at least about 80%, at least about 85%, at least about 90%, at least about 95%, at least about 96%, at least about 97%, at least about 98%, at least about 99%, or 100% identical to the sequence of SEQ ID NO:346, or any range of values thereof.

In some embodiments, the compositions comprising one or more saccharolytic enzymes described herein (e.g., an acetylxylanesterase, xylanase, and xylosidase) contain one or more enzymes recovered and/or purified from a host cell, strain, or culture of the invention. Such enzymes can be recovered, for example, from a cell supernatant either by acetone precipitation or by buffering the samples with disposable de-salting cartridges. Such enzymes can also be purified, for example, from a host cell, strain, or culture by spheroplast preparation and lysis, cell disruption using glass beads, or cell disruption using liquid nitrogen. Additional purification methods include, for example, ammonium sulfate or ethanol precipitation, acid extraction, anion or cation exchange chromatography, phosphocellulose chromatography, hydrophobic interaction chromatography, affinity chromatography, hydroxylapatite chromatography, gel filtration, and lectin chromatography. Protein refolding steps can also be used, as necessary, in completing configuration of the enzyme protein. Finally, high performance liquid chromatography (HPLC) can be employed for final purification steps. In some embodiments, the compositions comprising one or more saccharolytic enzymes described herein (e.g., an acetylxylanesterase, xylanase, and xylosidase) contain one or more enzymes from a crude extract of a host cell, strain, or culture of the invention.

As a practical matter, whether any polynucleotide or polypeptide is at least 70%, 80%, 85%, 90%, 95%, 96%, 97%, 98%, 99% or 100% identical to a polynucleotide or polypeptide of the present invention can be determined conventionally using known computer programs. Methods for determining percent identity, as discussed in more detail below in relation to polynucleotide identity, are also relevant for evaluating polypeptide sequence identity.

In some particular embodiments of the invention, the saccharolytic enzyme comprises a sequence selected from SEQ ID NOs:1-346. The saccharolytic enzymes of the invention also include saccharolytic enzymes that comprise a sequence at least about 70%, about 80%, about 90%, about 95%, about 96%, about 97%, about 98%, about 99%, 100% identical to SEQ ID NOs:1-346, or any range of values thereof. Amino acid and nucleic acid sequences are readily determined for a gene, protein, or other element by an accession number upon consulting the proper database, for example, Genebank. However, sequences for the genes and proteins of the present invention are also disclosed herein (SEQ ID NOs:1-346).

Some embodiments of the invention encompass a polynucleotide or polypeptide comprising at least 10, at least 20, at least 30, at least 40, at least 50, at least 60, at least 70, at least 80, at least 90, at least 100, at least 200, at least 300, at least 400, at least 500, or any range of values thereof, consecutive nucleotides or amino acids of SEQ ID NOs:1-346, or any domains, fragments, variants, or derivatives thereof.

In some aspects of the invention, the polypeptides and polynucleotides of the present invention are provided in an isolated form, e.g., purified to homogeneity.

The present invention also encompasses polynucleotides or polypeptides which comprise, or alternatively consist of, a polynucleotide or amino acid sequence which is at least about 80%, at least about 85%, at least about 90%, at least about 95%, at least about 96%, at least about 97%, at least about 98%, at least about 99%, or 100% similar to the polynucleotide or polypeptide of any of SEQ ID NOs:1-346, and to portions of such polynucleotide or polypeptide, with such portion of the polypeptide containing, for example, at least 30 amino acids or at least 50 amino acids.

As known in the art "similarity" between two polypeptides or polynucleotides is determined by comparing the polynucleotide or amino acid sequence and conserved substitutes thereto to the sequence of a second polynucleotide or polypeptide.

The present invention further relates to a domain, fragment, variant, derivative, or analog of a polypeptide or polynucleotide of any of SEQ ID NOs:1-346.

Fragments or portions of the polypeptides of the present invention can be employed for producing the corresponding full-length polypeptide by peptide synthesis. Therefore, the fragments can be employed as intermediates for producing the full-length polypeptides.

Fragments of lignocellulases of the invention encompass domains, proteolytic fragments, deletion fragments and in particular, fragments of any of SEQ ID NOs:1-346, which retain any specific biological activity. Fragments further include any portion of a polypeptide which retains a catalytic activity of endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, or feruoyl esterase protein.

The variant, derivative, or analog of SEQ ID NOs:1-346 can be (i) one in which one or more of the amino acid residues are substituted with a conserved or non-conserved amino acid residue (preferably a conserved amino acid residue) and such substituted amino acid residue may or may not be one encoded by the genetic code, or (ii) one in which one or more of the amino acid residues includes a substituent group, or (iii) one in which the mature polypeptide is fused with another compound, such as a compound to increase the half-life of the polypeptide (for example, polyethylene glycol), or (iv) one in which the additional amino acids are fused to the mature polypeptide for purification of the polypeptide or (v) one in which a fragment of the polypeptide is soluble, i.e., not membrane bound, yet still binds ligands to the membrane bound receptor. Such variants, derivatives and analogs are deemed to be within the scope of those skilled in the art from the teachings herein.

The polypeptides of the present invention further include variants of the polypeptides. A "variant" of the polypeptide can be a conservative variant, or an allelic variant. As used herein, a conservative variant refers to alterations in the amino acid sequence that do not adversely affect the biological functions of the protein. A substitution, insertion or deletion is said to adversely affect the protein when the altered sequence prevents or disrupts a biological function associated with the protein. For example, the overall charge, structure or hydrophobic-hydrophilic properties of the protein can be altered without adversely affecting a biological activity. Accordingly, the amino acid sequence can be altered, for example to render the peptide more hydrophobic or hydrophilic, without adversely affecting the biological activities of the protein.

By an "allelic variant" is intended alternate forms of a gene occupying a given locus on a chromosome of an organism. Genes II, Lewin, B., ed., John Wiley & Sons, New York (1985). Non-naturally occurring variants can be produced using art-known mutagenesis techniques. Allelic variants, though possessing a slightly different amino acid sequence than those recited above, will still have the same or similar biological functions associated with the endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterases, alpha-amylase, beta-amylase, glucoamylase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase of the invention. The allelic variants, the conservative substitution variants, and members of the endoglucanase, cellobiohydrolase, β-glucosidase, alpha-amylase, beta-amylase, glucoamylase, pullulanase, isopullulanase, or alpha-glucosidase protein families, can have an amino acid sequence having at least 75%, at least 80%, at least 90%, at least 95%, or at least 99% amino acid sequence identity with endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, and beta-glucosidase sequence set forth in any one of SEQ ID NOs:1-346. Identity or homology with respect to such sequences is defined herein as the percentage of polynucleotide or amino acid residues in the candidate sequence that are identical with a known sequence, after aligning the sequences and introducing gaps, if necessary, to achieve the maximum percent homology, and not considering any conservative substitutions as part of the sequence identity. N-terminal, C-terminal or internal extensions, deletions, or insertions into the sequence shall not be construed as affecting homology.

Thus, in one aspect the present invention includes molecules comprising the sequence of any one or more of SEQ ID NOs:1-346, or fragments thereof having a consecutive sequence of at least about 3, at least about 4, at least about 5, at least about 6, at least about 10, at least about 15, at least about 20, at least about 25, at least about 30, at least about 35 or more nucleotides or amino acid residues of the endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, or beta-glucosidase sequences. Amino acid sequence variants of such sequences wherein at least one amino acid residue has been inserted N- or C-terminal to, or within, the disclosed sequence; amino acid sequence variants of the disclosed sequences, or their fragments as defined above, that have been substituted by another residue. Contemplated variants further include those containing predetermined mutations by, e.g., homologous recombination, site-directed or PCR mutagenesis, and the corresponding proteins of other animal species, including but not limited to bacterial, fungal, insect, rabbit, rat, porcine, bovine, ovine, equine and non-human primate species, the alleles or other naturally occurring variants of the family of proteins; and derivatives wherein the protein has been covalently modified by substitution, chemical, enzymatic, or other appropriate means with a moiety other than a naturally occurring amino acid (for example, a detectable moiety such as an enzyme or radioisotope).

Using known methods of protein engineering and recombinant DNA technology, variants can be generated to improve or alter the characteristics of the polypeptides of saccharolytic enzymes. For instance, one or more amino acids can be deleted from the N-terminus or C-terminus of the secreted protein without substantial loss of biological function.

Thus, in another aspect the invention further includes endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptide variants which show substantial biological activity. Such variants include deletions, insertions, inversions, repeats, and substitutions selected according to general rules known in the art so as have little effect on activity.

The skilled artisan is fully aware of amino acid substitutions that are either less likely or not likely to significantly effect protein function (e.g., replacing one aliphatic amino acid with a second aliphatic amino acid), as further described below.

For example, guidance concerning how to make phenotypically silent amino acid substitutions is provided in Bowie et al., Deciphering the Message in Protein Sequences: Tolerance to Amino Acid Substitutions, *Science* 247:1306-1310 (1990), wherein the authors indicate that there are two main strategies for studying the tolerance of an amino acid sequence to change.

The first strategy exploits the tolerance of amino acid substitutions by natural selection during the process of evolution. By comparing amino acid sequences in different species, conserved amino acids can be identified. These conserved amino acids are likely important for protein function. In contrast, the amino acid positions where substitutions have been tolerated by natural selection indicates that these positions are not critical for protein function. Thus, positions tolerating amino acid substitution could be modified while still maintaining biological activity of the protein.

The second strategy uses genetic engineering to introduce amino acid changes at specific positions of a cloned gene to identify regions critical for protein function. For example, site directed mutagenesis or alanine-scanning mutagenesis (introduction of single alanine mutations at every residue in the molecule) can be used. (Cunningham and Wells, *Science* 244:1081-1085 (1989).) The resulting mutant molecules can then be tested for biological activity.

As the authors state, these two strategies have revealed that proteins are often surprisingly tolerant of amino acid substitutions. The authors further indicate which amino acid changes are likely to be permissive at certain amino acid positions in the protein. For example, most buried (within the tertiary structure of the protein) amino acid residues require nonpolar side chains, whereas few features of surface side chains are generally conserved. Moreover, tolerated conservative amino acid substitutions involve replacement of the aliphatic or hydrophobic amino acids Ala, Val, Leu, and Ile; replacement of the hydroxyl residues Ser and Thr; replacement of the acidic residues Asp and Glu; replacement of the amide residues Asn and Gln, replacement of the basic residues Lys, Arg, and His; replacement of the aromatic residues Phe, Tyr, and Trp; and replacement of the small-sized amino acids Ala, Ser, Thr, Met, and Gly.

The terms "derivative" and "analog" refer to a polypeptide differing from the endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides as disclosed herein, but retaining essential properties thereof. Generally, derivatives and analogs are overall closely similar, and, in many regions, identical to the endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides disclosed herein.

The terms "derivative" and "analog" when referring to endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and xylose transaldolase polypeptides include any polypeptides which retain at least some of the activity of the corresponding native polypeptide, e.g., the exoglucanase activity, or the activity of its catalytic domain.

Derivatives of the saccharolytic enzymes disclosed herein, are polypeptides which have been altered so as to exhibit features not found on the native polypeptide. Derivatives can be covalently modified by substitution, chemical, enzymatic, or other appropriate means with a moiety other than a naturally occurring amino acid (for example, a detectable moiety such as an enzyme or radioisotope). Examples of derivatives include fusion proteins.

An analog is another form of an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase polypeptide of the present invention. An "analog" also retains substantially the same biological function or activity as the polypeptide of interest, e.g., functions as a xylanase. An analog includes a proprotein which can be activated by cleavage of the proprotein portion to produce an active mature polypeptide.

The polypeptide of the present invention can be a recombinant polypeptide, a natural polypeptide or a synthetic polypeptide. In some particular embodiments, the polypeptide is a recombinant polypeptide.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to any of SEQ ID NOs:1-346 using information from the sequences disclosed herein or the clones deposited with the ATCC. For example, allelic variants and/or species homologs can be isolated and identified by making suitable probes or primers from the sequences provided herein and screening a suitable nucleic acid source for allelic variants and/or the desired homologue.

Combinations of Saccharolytic Enzymes

In some embodiments of the present invention, the host cell expresses a combination of heterologous saccharolytic enzymes. For example, the host cell can contain at least two heterologous saccharolytic enzymes, at least three heterologous saccharolytic enzymes, at least four heterologous saccharolytic enzymes, at least five heterologous saccharolytic enzymes, at least six heterologous saccharolytic enzymes, at least seven heterologous saccharolytic enzymes, at least eight heterologous saccharolytic enzymes, at least nine heterologous saccharolytic enzymes, at least ten heterologous saccharolytic enzymes, at least eleven heterologous saccharolytic enzymes, at least twelve heterologous saccharolytic enzymes, at least thirteen heterologous saccharolytic enzymes, at least fourteen heterologous saccharolytic enzymes, at least fifteen heterologous saccharolytic enzymes, or any range of numbers of enzymes thereof. The heterologous saccharolytic enzymes in the host cell can be from the same species or from different species. In some embodiments, the host cell expresses heterologous enzymes comprising cellobiohydrolases, endo-gluconases, beta-glucosidases, xylanases, xylosidases, glucoamylases, alpha-amylases, alpha-glucosidases, pullulanases, isopullulanases, pectinases, or acetylxylan esterases.

In some embodiments, the host cell contains an acetylxylanesterase, a xylanase, and a xylosidase. In some embodiments, the host cell contains an acetylxylanesterase, a xylanase, a xylosidase, and a galactosidase. In some embodiments, the host cell contains an acetylxylanesterase, a xylanase, a xylosidase, a galactosidase, and a mannosidase. In some embodiments, the host cell contains an acetylxylanesterase, a xylanase, a xylosidase, a galactosidase, a mannosidase, and an alpha-glucuronidase. In some embodiments, the acetylxylanesterase is selected from SEQ ID NOs:6-10. In some embodiments, the xylanase is selected from SEQ ID NOs:37-62. In some embodiments, the xylosidase is selected from SEQ ID NOs:78-92. In some embodiments, the galactosidase is selected from SEQ ID NOs:108-122. In some embodiments, the mannosidase is selected from SEQ ID NOs:146-168. In some embodiments, the alpha-glucuronidase is selected from SEQ ID NOs:184-198.

In some embodiments, the host cell containing an acetylxylanesterase, xylanase, and xylosidase further comprises a heterologous polynucleotide comprising a nucleic acid which encodes an acetyl esterase. In some embodiments, the nucleic acid which encodes an acetyl esterase encodes a polypeptide comprising an amino acid sequence at least about 90%, 95%, 96%, 97%, 98% or 99% identical, or other percent identity disclosed herein, to any one of SEQ ID NOs:223-225. In some embodiments, the nucleic acid which encodes an acetyl esterase encodes a polypeptide comprising an amino acid sequence identical to any one of SEQ ID NOs:223-225. In some embodiments, the nucleic acid comprises any one of SEQ ID NOs:207-209 or a percent identity thereof disclosed herein.

In some embodiments, the host cell containing an acetylxylanesterase, xylanase, xylosidase, and acetyl esterase further comprises a heterologous polynucleotide comprising a nucleic acid which encodes an alpha-glucuronidase. In some embodiments, the nucleic acid which encodes an alpha-glucuronidase encodes a polypeptide comprising an amino acid sequence at least about 90%, 95%, 96%, 97%, 98% or 99% identical, or other percent identity disclosed herein, to any one of SEQ ID NOs:185-198. In some embodiments, the nucleic acid which encodes an alpha-glucuronidase encodes a polypeptide comprising an amino acid sequence identical to any one of SEQ ID NOs:185-198. In some embodiments, the nucleic acid comprises any one of SEQ ID NOs:170-183 or a percent identity thereof disclosed herein. In other embodiments, the host cell further comprises a heterologous polynucleotide comprising a nucleic acid which encodes a beta-glucosidase. In some embodiments, the nucleic acid which encodes a beta-glucosidase encodes a polypeptide comprising an amino acid sequence at least about 90%, 95%, 96%, 97%, 98% or 99% identical, or other percent identity disclosed herein, to any one of SEQ ID NOs:92, 164-168, 226 and 227. In some embodiments, the nucleic acid which encodes a beta-glucosidase encodes a polypeptide comprising an amino acid sequence identical to any one of SEQ ID NOs: 92, 164-168, 226 and 227. In some embodiments, the nucleic acid comprises any one of SEQ ID NOs:77, 141-145, 210 and 211 or a percent identity thereof disclosed herein. In some embodiments, the recombinant host cell further comprises a heterologous polynucleotide comprising a nucleic acid which encodes an alpha-galactosidase. In some embodiments, the nucleic acid which encodes an alpha-galactosidase encodes a polypeptide comprising an amino acid sequence at least about 90%, 95%, 96%, 97%, 98% or 99% identical to any one of SEQ ID NOs:108-122. In some embodiments, the nucleic acid which encodes an alpha-galactosidase encodes a polypeptide comprising an amino acid sequence identical to any one of SEQ ID NOs:108-122. In some embodiments, the recombinant host cell further comprises a heterologous polynucleotide comprising a nucleic acid which encodes a β-mannosidase. In some embodiments, the nucleic acid which encodes the β-mannosidase encodes a polypeptide that is at least about 90%, 95%, 96%, 97%, 98% or 99% identical to a sequence selected from SEQ ID NOs:147-168. In some embodiments, the nucleic acid which encodes the β-mannosidase encodes a polypeptide that is identical to a sequence selected from SEQ ID NOs:147-168.

In other embodiments, the recombinant host cell containing an acetylxylanesterase, xylanase, xylosidase and acetyl esterase further comprises a heterologous polynucleotide comprising a nucleic acid which encodes an alpha-galactosidase. In some embodiments, the nucleic acid which encodes an alpha-galactosidase encodes a polypeptide comprising an amino acid sequence at least about 90% identical, or other percent identity disclosed herein, to any one of SEQ ID NOs:108-122. In some embodiments, the nucleic acid which encodes an alpha-galactosidase encodes a polypeptide comprising an amino acid sequence identical to any one of SEQ ID NOs:108-122. In some embodiments, the nucleic acid comprises any one of SEQ ID NOs:93-107 or a percent identity thereof disclosed herein. In some embodiments, the recombinant host cell further comprises a heterologous polynucleotide comprising a nucleic acid which encodes an endoglucanase. In some embodiments, the nucleic acid which encodes an endoglucanase encodes a polypeptide comprising an amino acid sequence at least about 90% identical, or other percent identity disclosed herein, to any one of SEQ ID NOs:289-345. In some embodiments, the nucleic acid which encodes an endoglucanase encodes a polypeptide comprising an amino acid sequence identical to any one of SEQ ID NOs:289-345. In some embodiments, the nucleic acid comprises any one of SEQ ID NOs:231-287 or a percent identity thereof disclosed herein.

In some embodiments, the host cell comprises at least one saccharolytic enzyme encoding a polypeptide comprising an amino acid sequence of SEQ ID NOs:108, 115-122, 146, 155-168, 184, 188-197, 215-225, 227, 228, or combinations thereof. In some embodiments, the host cell comprises at least one saccharolytic enzyme encoding a polypeptide comprising an amino acid sequence of SEQ ID NOs:55, 92, 146, 147, 160-163, 215-230, 289-345, or combinations thereof.

In some embodiments, the host cell comprises saccharolytic enzymes encoded by SEQ ID NO:8, SEQ ID NO:37, and SEQ ID NO:78. In some embodiments, the host cell comprises saccharolytic enzymes encoded by SEQ ID NO:8, SEQ ID NO:37, SEQ ID NO:78 and SEQ ID NO:108. In some embodiments, the host cell comprises saccharolytic enzymes encoded by SEQ ID NO:8, SEQ ID NO:37, SEQ ID NO:78, SEQ ID NO:108, and SEQ ID NO:146. In some embodiments, the host cell comprises saccharolytic enzymes encoded by SEQ ID NO:8, SEQ ID NO:37, SEQ ID NO:78, SEQ ID NO:108, SEQ ID NO:146, and SEQ ID NO:184.

Tethered and Secreted Saccharolytic Enzymes

According to the present invention, the saccharolytic enzymes can be either tethered or secreted. As used herein, a protein is "tethered" to an organism's cell surface if at least one terminus of the protein is bound, covalently and/or electrostatically for example, to the cell membrane or cell wall. It will be appreciated that a tethered protein can include one or more enzymatic regions that can be joined to one or more other types of regions at the nucleic acid and/or protein levels (e.g., a promoter, a terminator, an anchoring domain, a linker, a signaling region, etc.). While the one or more enzymatic regions may not be directly bound to the cell membrane or cell wall (e.g., such as when binding occurs via an anchoring domain), the protein is nonetheless considered a "tethered enzyme" according to the present specification.

Tethering can, for example, be accomplished by incorporation of an anchoring domain into a recombinant protein that is heterologously expressed by a cell, or by prenylation, fatty acyl linkage, glycosyl phosphatidyl inositol anchors, or other suitable molecular anchors which can anchor the tethered protein to the cell membrane or cell wall of the host cell. A tethered protein can be tethered at its amino terminal end or optionally at its carboxy terminal end.

As used herein, "secreted" means released into the extra-cellular milieu, for example into the media. Although tethered proteins can have secretion signals as part of their immature amino acid sequence, they are maintained as attached to the cell surface, and do not fall within the scope of secreted proteins as used herein.

As used herein, "flexible linker sequence" refers to an amino acid sequence which links two amino acid sequences, for example, a cell wall anchoring amino acid sequence with an amino acid sequence that contains the desired enzymatic activity. The flexible linker sequence allows for necessary freedom for the amino acid sequence that contains the desired enzymatic activity to have reduced steric hindrance with respect to proximity to the cell and can also facilitate proper folding of the amino acid sequence that contains the desired enzymatic activity.

In some embodiments of the present invention, the tethered cellulase enzymes are tethered by a flexible linker sequence linked to an anchoring domain. In some embodiments, the anchoring domain is of CWP2 (for carboxy terminal anchoring) or FLO1 (for amino terminal anchoring) from *S. cerevisiae*.

In some embodiments, heterologous secretion signals can be added to the expression vectors of the present invention to facilitate the extra-cellular expression of cellulase proteins. In some embodiments, the heterologous secretion signal is the secretion signal from *T. reesei* Xyn2. In other embodiments, the heterologous secretion signal is the *S. cerevisiae* Invertase signal. In yet other embodiments, the heterologous secretion signal is the *S. cerevisiae* AF mating signal.

Fusion Proteins Comprising Saccharolytic Enzymes

The present invention also encompasses fusion proteins. For example, the fusion proteins can be a fusion of a heterologous saccharolytic enzyme and a second peptide. The heterologous saccharolytic enzyme and the second peptide can be fused directly or indirectly, for example, through a linker sequence. The fusion protein can comprise for example, a second peptide that is N-terminal to the heterologous saccharolytic enzyme and/or a second peptide that is C-terminal to the heterologous saccharolytic enzyme. Thus, in certain embodiments, the polypeptide of the present invention comprises a first polypeptide and a second polypeptide, wherein the first polypeptide comprises a heterologous saccharolytic enzyme.

According to one aspect of the present invention, the fusion protein can comprise a first and second polypeptide wherein the first polypeptide comprises a heterologous saccharolytic enzyme and the second polypeptide comprises a signal sequence. According to another embodiment, the fusion protein can comprise a first and second polypeptide, wherein the first polypeptide comprises a heterologous saccharolytic enzyme and the second polypeptide comprises a polypeptide used to facilitate purification or identification or a reporter peptide. The polypeptide used to facilitate purification or identification or the reporter peptide can be, for example, a HIS-tag, a GST-tag, an HA-tag, a FLAG-tag, a MYC-tag, or a fluorescent protein. In some embodiments, the fusion protein is a histidine tag fused to a saccharolytic enzyme.

According to yet another embodiment, the fusion protein can comprise a first and second polypeptide, wherein the first polypeptide comprises a heterologous saccharolytic enzyme and the second polypeptide comprises an anchoring peptide. In some embodiments, the anchoring domain is of CWP2 (for carboxy terminal anchoring) or FLO1 (for amino terminal anchoring) from *S. cerevisiae*.

According to yet another embodiment, the fusion protein can comprise a first and second polypeptide, wherein the first polypeptide comprises a heterologous saccharolytic enzyme and the second polypeptide comprises a cellulose binding module (CBM or SBM). In some embodiments, the CBM is from, for example, *T. reesei* Cbh1 or Cbh2 or from *C. lucknowense* Cbh2b. In some particular embodiments, the CBM is fused to an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

In certain embodiments, the polypeptide of the present invention encompasses a fusion protein comprising a first polypeptide and a second polypeptide, wherein the first polypeptide is an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase; and the second polypeptide is selected from a polypeptide encoded by a domain or fragment of a saccharolytic enzyme disclosed herein. In certain embodiments, the polypeptides of the present invention encompass a fusion protein comprising a first saccharolytic enzyme polypeptide, wherein the first polypeptide is a domain, derivative, or fragment of any saccharolytic enzyme polypeptide disclosed herein, and a second polypeptide, where the second polypeptide is a *T. emersonii* Cbh1 *H. grisea* Cbh1, *T. aurantiacusi* Cbh1, *T. emersonii* Cbh2, *T. reesei* Cbh1, *T. reesei* Cbh2, *C. lucknowense* Cbh2b, or domain, fragment, variant, or derivative thereof. In additional embodiments, the first polypeptide is either N-terminal or C-terminal to the second polypeptide. In certain other embodiments, the first polypeptide and/or the second polypeptide are encoded by codon-optimized polynucleotides, for example, polynucleotides codon-optimized for *S. cerevisiae* or *Kluyveromyces*.

In certain other embodiments, the first polypeptide and the second polypeptide are fused via a linker sequence. The linker sequence can, in some embodiments, be encoded by a codon-optimized polynucleotide. (Codon-optimized polynucleotides are described in more detail below.) An amino acid sequence corresponding to a codon-optimized linker 1 according to the invention is a flexible linker-strep tag-TEV site-FLAG-flexible linker fusion and corresponds to GGGGSGGGGS AWHPQFGG ENLYFQG DYKDDDK GGGGSGGGGS (SEQ ID NO:443). In some embodiments, the linker is ddddkggsppshhhhhh, where ddddk is the enterokinase cleavage site, the ggspps is the linker site and hhhhhh is the His tag (SEQ ID NO: 602).

An exemplary DNA sequence is as follows: GGAGGAG-GTGGTTCAGGAGGTGGTGGGTCTGCTTGGCATC-CACAATTTGGAG GAGGCGGTGGTGAAAATCTGT-ATTTCCAGGGAGGCGGAGGTGATTACAAGGA TGACGACAAAGGAGGTGGTGGATCAGGAGGTG-GTGGCTCC (SEQ ID NO:444).

An amino acid sequence corresponding to optimized linker 2 is a flexible linker-strep tag-linker-TEV site-flexible linker and corresponds to GGGGSGGGGS WSHPQFEK GG ENLYFQG GGGGSGGGGS (SEQ ID NO:445).

The DNA sequence is as follows: ggtggcggtggatctggag-gaggcggttcttggtctcacccacaatttgannagggtggaganaacttg-tactttcaaggeggtg gtggaggttctggcggaggtggctccggctca (SEQ ID NO:446).

Co-Cultures

In another aspect, the present invention is directed to co-cultures comprising at least two yeast host cells wherein the at least two yeast host cells each comprise an isolated polynucleotide encoding a saccharolytic enzyme. As used herein, "co-culture" refers to growing two different strains or species of host cells together in the same vessel. In some embodiments of the invention, at least one host cell of the co-culture comprises a heterologous polynucleotide comprising a nucleic acid which encodes an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, pullulanase, isopullulanase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase. In some embodiments, at least one host cell of the co-culture comprises a heterologous polynucleotide comprising a nucleic acid which encodes a different endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, beta-glucosidase, pullulanase, isopullulanase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase, and at least one host cell comprises a heterologous polynucleotide comprising a nucleic acid which encodes a still different endoglucanase, glucosidase, cellobiohydrolase, xylanase, glucanase, xylosidase, xylan esterase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, alpha-glucosidase, beta-glucosidase, pullulanase, isopullulanase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The co-culture can comprise two or more strains of yeast host cells, and the heterologous saccharolytic enzymes can be expressed in any combination in the two or more strains of host cells. For example, according to the present invention, the co-culture can comprise two strains: one strain of host cells that expresses an endoglucanase and a second strain of host cells that expresses a β-glucosidase, a cellobiohydrolase and a second cellobiohydrolase. Similarly, the co-culture can comprise one strain of host cells that expresses two saccharolytic enzymes, for example an endoglucanase and a beta-glucosidase and a second strain of host cells that expresses one or more saccharolytic enzymes, for example one or more endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase. The co-culture can, in addition to the at least two host cells comprising heterologous saccharolytic enzymes, also include other host cells which do not comprise heterologous saccharolytic enzymes. The co-culture can comprise one strain expressing an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase; and a second host cell expressing an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The various host cell strains in the co-culture can be present in equal numbers, or one strain or species of host cell can significantly outnumber another second strain or species of host cells. For example, in a co-culture comprising two strains or species of host cells the ratio of one host cell to another can be about 1:1, about 1:2, about 1:3, about 1:4, about 1:5, about 1:10, about 1:100, about 1:500 or about 1:1000. Similarly, in a co-culture comprising three or more strains or species of host cells, the strains or species of host cells can be present in equal or unequal numbers.

Biomass feedstocks contain varying proportions of starch, lignocellulose, or pentose sugars. Therefore, in one aspect, yeast strains express different saccharolytic enzymes at different levels.

In some embodiments, a host cell comprising polynucleotides that encode for an acetylxylanesterase, xylanase, xylosidase, alpha-galactosidase, and alpha-glucuronidase is co-cultured with at least one host cell selected from the following: a host cell comprising a polynucleotide encoding a beta-mannosidase, a host cell comprising a polynucleotide encoding a beta-mannanase, a host cell comprising a polynucleotide encoding an endoglucanase I, a host cell comprising a polynucleotide encoding a beta-glucosidase, and a host cell comprising a polynucleotide encoding an acetyl esterase. In some embodiments, a host cell comprising polynucleotides that encode for an acetylxylanesterase, xylanase, xylosidase, alpha-galactosidase, and alpha-glucuronidase is co-cultured with at least two host cells selected from the following: a host cell comprising a polynucleotide encoding a beta-mannosidase, a host cell comprising a polynucleotide encoding a beta-mannanase, a host cell comprising a polynucleotide encoding an endoglucanase I, a host cell comprising a polynucleotide encoding a beta-glucosidase, and a host cell comprising a polynucleotide encoding an acetyl esterase. In some embodiments, a host cell comprising polynucleotides that encode for an acetylxylanesterase, xylanase, xylosidase, alpha-galactosidase, and alpha-glucuronidase is co-cultured with at least three host cells selected from the following: a host cell comprising a polynucleotide encoding a beta-mannosidase, a host cell comprising a polynucleotide encoding a beta-mannanase, a host cell comprising a polynucleotide encoding an endoglucanase I, a host cell comprising a polynucleotide encoding a beta-glucosidase, and a host cell comprising a polynucleotide encoding an acetyl esterase. In some embodiments, a host cell comprising polynucleotides that encode for an acetylxylanesterase, xylanase, xylosidase, alpha-galactosidase, and alpha-glucuronidase is co-cultured with at least four host cells selected from the following: a host cell comprising a polynucleotide encoding a beta-mannosidase, a host cell comprising a polynucleotide encoding a beta-mannanase, a host cell comprising a polynucleotide encoding an endoglucanase I, a host cell comprising a polynucleotide encoding a beta-glucosidase, and a host cell comprising a polynucleotide encoding an acetyl esterase. In some embodiments, a host cell comprising polynucleotides that encode for an acetylxylanesterase, xylanase, xylosidase, alpha-galactosidase, and alpha-glucuronidase is co-cultured with a host cell comprising a polynucleotide encoding a beta-mannosidase, a host cell comprising a polynucleotide encoding a beta-mannanase, a host cell comprising a polynucleotide encoding an endoglucanase I, a host cell comprising a polynucleotide encoding a beta-glucosidase, and a host cell comprising a polynucleotide encoding an acetyl esterase.

In some embodiments, the co-culture is comprised of any of the previously described host cells, a recombinant yeast host cell comprising a heterologous polynucleotide comprising a nucleic acid which encodes a polypeptide comprising an amino acid sequence identical to SEQ ID NO:146, a recombinant yeast host cell comprising a heterologous polynucleotide comprising a nucleic acid which encodes a polypeptide comprising an amino acid sequence identical to SEQ ID NO:147, a recombinant yeast host cell comprising a heterologous polynucleotide comprising a nucleic acid which encodes a polypeptide comprising an amino acid sequence identical to SEQ ID NO:289, a recombinant yeast host cell comprising a heterologous polynucleotide comprising a nucleic acid which encodes a polypeptide comprising an amino acid sequence identical to SEQ ID NO:226, and/or a recombinant yeast host cell comprising a heterologous polynucleotide comprising a nucleic acid which encodes a polypeptide comprising an amino acid sequence identical to SEQ ID NO:224.

In some embodiments, the co-culture is comprised of any of the previously described host cells and at least one host cell selected from the group consisting of: a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:146, 147, 160-163, 215-222, and 228-230, a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:54 and 289-345; a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:92, 226, and 227; and a recombinant yeast host cell comprising a heterologous polynucleotide comprising a nucleic acid which encodes a polypeptide comprising an amino acid sequence at least about 90%, 95%, 96%, 97%, 98% or 99% identical to any one of SEQ ID NOs:223-225.

In some embodiments, the co-culture comprises one or more of yeast strains M3318, M2295, M3240, M3460, M4494, M2963, M4042, M4044, M4638, M4642, M4777, M4782, M4821, M4836, M4888, M5401, M5453, or any other strain described herein.

The co-cultures of the present invention can include tethered saccharolytic enzymes, secreted saccharolytic enzymes, or both tethered and secreted saccharolytic enzymes. For example, in some embodiments of the invention, the co-culture comprises at least one yeast host cell comprising a polynucleotide encoding a secreted heterologous saccharolytic enzyme. In another embodiment, the co-culture comprises at least one yeast host cell comprising a polynucleotide encoding a tethered heterologous saccharolytic enzyme. In one embodiment, all of the heterologous saccharolytic enzymes in the co-culture are secreted, and in another embodiment, all of the heterologous saccharolytic enzymes in the co-culture are tethered. In addition, other saccharolytic enzymes, such as externally added saccharolytic enzymes can be present in the co-culture.

Polynucleotides Encoding Heterologous Saccharolytic Enzymes

In another aspect, the present invention includes isolated polynucleotides encoding saccharolytic enzymes of the present invention. Thus, the polynucleotides of the invention can encode for example, endoglucanases, exoglucanases, amylases, or pentose sugar utilizing enzymes. The polynucleotides can encode an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase.

The present invention also encompasses an isolated polynucleotide comprising a nucleic acid that is at least about 70%, at least about 75%, at least about 80%, at least about 90%, at least about 95%, at least about 96%, at least about 97%, at least about 98%, at least about 99%, 100% identical, or any range of values thereof, to a nucleic acid encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, and arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase disclosed herein.

The present invention also encompasses variants of the saccharolytic enzyme genes, as described above. Variants can contain alterations in the coding regions, non-coding regions, or both coding and non-coding regions. Examples of polynucleotide variants include those containing alterations which produce silent substitutions, additions, or deletions, but do not alter the properties or activities of the encoded polypeptide. In certain embodiments, nucleotide variants are produced by silent substitutions due to the degeneracy of the genetic code. In further embodiments, endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase polynucleotide variants can be produced for a variety of reasons, e.g., to optimize codon expression for a particular host. Codon-optimized polynucleotides of the present invention are discussed further below.

The present invention also encompasses an isolated polynucleotide encoding a fusion protein. In certain embodiments, the nucleic acid encoding a fusion protein comprises a first polynucleotide encoding a endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase as disclosed herein and a CBD (as described above).

In further embodiments, the first and second polynucleotides are in the same orientation, or the second polynucleotide is in the reverse orientation of the first polynucleotide. In additional embodiments, the first polynucleotide encodes a polypeptide that is either N-terminal or C-terminal to the polypeptide encoded by the second polynucleotide. In certain other embodiments, the first polynucleotide and/or the second polynucleotide are encoded by codon-optimized polynucleotides, for example, polynucleotides codon-optimized for *S. cerevisiae, Kluyveromyces* or for both *S. cerevisiae* and *Kluyveromyces*.

Also provided in the present invention are allelic variants, orthologs, and/or species homologs. Procedures known in the art can be used to obtain full-length genes, allelic variants, splice variants, full-length coding portions, orthologs, and/or species homologs of genes corresponding to any of SEQ ID NOs:1-346, using information from the sequences disclosed herein or the clones deposited with the ATCC or otherwise publically available. For example, allelic variants and/or species homologs can be isolated and identified by making suitable probes or primers from the sequences provided herein and screening a suitable nucleic acid source for allelic variants and/or the desired homologue.

By a nucleic acid having a nucleotide sequence at least, for example, 95% "identical" to a reference nucleotide sequence of the present invention, it is intended that the nucleotide sequence of the nucleic acid is identical to the reference sequence except that the nucleotide sequence can include up to five point mutations per each 100 nucleotides of the reference nucleotide sequence encoding the particular polypeptide. In other words, to obtain a nucleic acid having a nucleotide sequence at least 95% identical to a reference nucleotide sequence, up to 5% of the nucleotides in the reference sequence can be deleted or substituted with another nucleotide, or a number of nucleotides up to 5% of the total nucleotides in the reference sequence can be inserted into the reference sequence. The query sequence can be an entire sequence shown of any of SEQ ID NOs: 1-346, or any fragment or domain specified as described herein.

As a practical matter, whether any particular nucleic acid molecule or polypeptide is at least 80%, at least 85%, at least 90%, at least 95%, at least 96%, at least 97%, at least 98% or at least 99% identical to a nucleotide sequence or polypeptide of the present invention can be determined conventionally using known computer programs. A method for determining the best overall match between a query sequence (a sequence of the present invention) and a subject sequence, also referred to as a global sequence alignment, can be determined using the FASTDB computer program based on the algorithm of Brutlag et al., *Comp. App. Biosci.* 6:237-245 (1990)). In a sequence alignment the query and subject sequences are both DNA sequences. An RNA sequence can be compared by converting U's to T's. The result of said global sequence alignment is in percent identity. Preferred parameters used in a FASTDB alignment of DNA sequences to calculate percent identity are: Matrix=Unitary, k-tuple=4, Mismatch Penalty=1, Joining Penalty=30, Randomization Group Length=0, Cutoff Score=1, Gap Penalty=5, Gap Size Penalty 0.05, Window Size=500 or the length of the subject nucleotide sequence, whichever is shorter.

If the subject sequence is shorter than the query sequence because of 5' or 3' deletions, not because of internal deletions, a manual correction must be made to the results. This is because the FASTDB program does not account for 5' and 3' truncations of the subject sequence when calculating percent identity. For subject sequences truncated at the 5' or 3' ends, relative to the query sequence, the percent identity is corrected by calculating the number of bases of the query sequence that are 5' and 3' of the subject sequence, which are not matched/aligned, as a percent of the total bases of the query sequence. Whether a nucleotide is matched/aligned is determined by results of the FASTDB sequence alignment. This percentage is then subtracted from the percent identity, calculated by the above FASTDB program using the specified parameters, to arrive at a final percent identity score. This corrected score is what is used for the purposes of the present invention. Only bases outside the 5' and 3' bases of the subject sequence, as displayed by the FASTDB alignment, which are not matched/aligned with the query sequence, are calculated for the purposes of manually adjusting the percent identity score.

For example, a 90 base subject sequence is aligned to a 100 base query sequence to determine percent identity. The deletions occur at the 5' end of the subject sequence and therefore, the FASTDB alignment does not show a matched/alignment of the first 10 bases at 5' end. The 10 unpaired bases represent 10% of the sequence (number of bases at the 5' and 3' ends not matched/total number of bases in the query sequence) so 10% is subtracted from the percent identity score calculated by the FASTDB program. If the remaining 90 bases were perfectly matched the final percent identity would be 90%. In another example, a 90 base subject sequence is compared with a 100 base query sequence. This time the deletions are internal deletions so that there are no bases on the 5' or 3' of the subject sequence which are not matched/aligned with the query. In this case the percent identity calculated by FASTDB is not manually corrected. Once again, only bases 5' and 3' of the subject sequence which are not matched/aligned with the query sequence are manually corrected for. No other manual corrections are to be made for the purposes of the present invention.

Some embodiments of the invention encompass a nucleic acid molecule comprising at least 10, at least 20, at least 30, at least 35, at least 40, at least 50, at least 60, at least 70, at least 80, at least 90, at least 100, at least 200, at least 300, at least 400, at least 500, at least 600, at least 700, or at least 800 consecutive nucleotides, or more, of any of SEQ ID NO. disclosed herein, or domains, fragments, variants, or derivatives thereof.

The polynucleotide of the present invention can be in the form of RNA or in the form of DNA, which DNA includes cDNA, genomic DNA, and synthetic DNA. The DNA can be double stranded or single-stranded, and if single stranded can be the coding strand or non-coding (anti-sense) strand. The coding sequence which encodes the mature polypeptide can be identical to the coding sequence encoding any SEQ ID NO. disclosed herein, or can be a different coding sequence which coding sequence, as a result of the redundancy or degeneracy of the genetic code, encodes the same mature polypeptide as the nucleic acid sequences of any SEQ ID NO. disclosed herein.

In certain embodiments, the present invention provides an isolated polynucleotide comprising a nucleic acid fragment which encodes at least 10, at least 20, at least 30, at least 40, at least 50, at least 60, at least 70, at least 80, at least 90, at least 95, or at least 100 or more contiguous amino acids of any SEQ ID NO. disclosed herein.

The polynucleotide encoding for the mature polypeptide of any SEQ ID NO. disclosed herein can include: only the coding sequence for the mature polypeptide; the coding sequence of any domain of the mature polypeptide; or the coding sequence for the mature polypeptide (or domain-encoding sequence) together with non-coding sequence, such as introns or non-coding sequence 5' and/or 3' of the coding sequence for the mature polypeptide.

Thus, the term "polynucleotide encoding a polypeptide" encompasses a polynucleotide which includes only sequences encoding for the polypeptide as well as a polynucleotide which includes additional coding and/or non-coding sequences.

In further aspects of the invention, nucleic acid molecules having sequences at least about 90%, at least about 95%, at least about 96%, at least about 97%, at least about 98% or at least about 99% identical to the nucleic acid sequences disclosed herein encoding a polypeptide having an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase functional activity.

Of course, due to the degeneracy of the genetic code, one of ordinary skill in the art will immediately recognize that a large portion of the nucleic acid molecules having a sequence at least 90%, at least 95%, at least 96%, at least 97%, at least 98%, or at least 99% identical to the nucleic acid sequence disclosed herein, or fragments thereof, will encode polypeptides having functional activity. In fact, since degenerate variants of any of these nucleotide sequences all encode the same polypeptide, in many instances, this will be clear to the skilled artisan even without performing the above described comparison assay. It will be further recognized in the art that, for such nucleic acid molecules that are not degenerate variants, a reasonable number will also encode a polypeptide having functional activity.

The polynucleotides of the present invention also comprise nucleic acids encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, or xylose transaldolase, or a domain, fragment, variant, or derivative thereof, fused to a polynucleotide encoding a marker sequence which allows for detection of the polynucleotide of the present invention. In one embodiment of the invention, expression of the marker sequence is independent from expression of the saccharolytic enzyme. The marker sequence can be a yeast selectable marker selected from the group consisting of URA3, HIS3, LEU2, TRP1, LYS2, ADE2 or any other suitable selectable marker known in the art. Casey, G. P. et al., A convenient dominant selection marker for gene transfer in industrial strains of *Saccharomyces* yeast: SMR1 encoded resistance to the herbicide sulfometuron methyl, *J. Inst. Brew.* 94:93-97 (1988).

Codon Optimized Polynucleotides

According to one embodiment of the invention, the polynucleotides encoding heterologous saccharolytic enzymes can be codon-optimized. As used herein, the term "codon-optimized coding region" means a nucleic acid coding region that has been adapted for expression in the cells of a given organism by replacing at least one, or more than one, or a significant number, of codons with one or more codons that are more frequently used in the genes of that organism.

In general, highly expressed genes in an organism are biased towards codons that are recognized by the most abundant tRNA species in that organism. One measure of this bias is the "codon adaptation index" or "CAI," which measures the extent to which the codons used to encode each amino acid in a particular gene are those which occur most frequently in a reference set of highly expressed genes from an organism.

The CAI of codon optimized sequences of the present invention corresponds to between about 0.8 and 1.0, between about 0.8 and 0.9, or about 1.0. A codon optimized sequence can be further modified for expression in a particular organism, depending on that organism's biological constraints. For example, large runs of "As" or "Ts" (e.g., runs greater than 4, greater than 5, greater than 6, greater than 7, greater than 8, greater than 9, or greater than 10 consecutive bases) can be removed from the sequences if these are known to effect transcription negatively. Furthermore, specific restriction enzyme sites can be removed for molecular cloning purposes. Examples of such restriction enzyme sites include, for example, PacI, AscI, BamHI, BglII, EcoRI, and XhoI. Additionally, the DNA sequence can be checked for direct repeats, inverted repeats and mirror repeats with lengths of ten bases or longer, which can be modified manually by replacing codons with "second best" codons, i.e., codons that occur at the second highest frequency within the particular organism for which the sequence is being optimized.

Deviations in the nucleotide sequence that comprise the codons encoding the amino acids of any polypeptide chain allow for variations in the sequence coding for the gene. Since each codon consists of three nucleotides, and the nucleotides comprising DNA are restricted to four specific bases, there are 64 possible combinations of nucleotides, 61 of which encode amino acids (the remaining three codons encode signals ending translation). The "genetic code" which shows which codons encode which amino acids is reproduced herein as Table 1. As a result, many amino acids are designated by more than one codon. For example, the amino acids alanine and proline are coded for by four triplets, serine and arginine by six, whereas tryptophan and methionine are coded by just one triplet. This degeneracy allows for DNA base composition to vary over a wide range without altering the amino acid sequence of the proteins encoded by the DNA.

TABLE 1

The Standard Genetic Code

|   | T | C | A | G |
|---|---|---|---|---|
| T | TTT Phe (F) | TCT Ser (S) | TAT Tyr (Y) | TGT Cys (C) |
|   | TTC " | TCC " | TAC " | TGC " |
|   | TTA Leu (L) | TCA " | TAA Ter | TGA Ter |
|   | TTG " | TCG " | TAG Ter | TGG Trp (W) |
| C | CTT Leu (L) | CCT Pro (P) | CAT His (H) | CGT Arg (R) |
|   | CTC " | CCC " | CAC " | CGC " |
|   | CTA " | CCA " | CAA Gln (Q) | CGA " |
|   | CTG " | CCG " | CAG " | CGG " |
| A | ATT Ile (I) | ACT Thr (T) | AAT Asn (N) | AGT Ser (S) |
|   | ATC " | ACC " | AAC " | AGC " |
|   | ATA " | ACA " | AAA Lys (K) | AGA Arg (R) |
|   | ATG Met (M) | ACG " | AAG " | AGG " |
| G | GTT Val (V) | GCT Ala (A) | GAT Asp (D) | GGT Gly (G) |
|   | GTC " | GCC " | GAC " | GGC " |
|   | GTA " | GCA " | GAA Glu (E) | GGA " |
|   | GTG " | GCG " | GAG " | GGG " |

Many organisms display a bias for use of particular codons to code for insertion of a particular amino acid in a growing peptide chain. Codon preference or codon bias, differences in codon usage between organisms, is afforded by degeneracy of the genetic code, and is well documented among many organisms. Codon bias often correlates with the efficiency of translation of messenger RNA (mRNA), which is in turn believed to be dependent on, inter alia, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization.

Given the large number of gene sequences available for a wide variety of animal, plant and microbial species, it is possible to calculate the relative frequencies of codon usage. Codon usage Tables are readily available, for example, at http://www.kazusa.or.jp/codon/ (visited Aug. 24, 2012), and these tables can be adapted in a number of ways. See Nakamura, Y., et al., Codon usage tabulated from the international DNA sequence databases: status for the year 2000, *Nucl. Acids Res.* 28:292 (2000). Codon usage tables for yeast, calculated from GenBank Release 128.0 [15 Feb. 2002], are reproduced below as Table 2. This Table uses mRNA nomenclature, and so instead of thymine (T) which is found in DNA, the tables use uracil (U) which is found in RNA. The Table has been adapted so that frequencies are calculated for each amino acid, rather than for all 64 codons.

TABLE 2

Codon Usage Table for *Saccharomyces cerevisiae* Genes

| Amino Acid | Codon | Number | Frequency per hundred |
|---|---|---|---|
| Phe | UUU | 170666 | 26.1 |
| Phe | UUC | 120510 | 18.4 |
| Total | | | |
| Leu | UUA | 170884 | 26.2 |
| Leu | UUG | 177573 | 27.2 |
| Leu | CUU | 80076 | 12.3 |
| Leu | CUC | 35545 | 5.4 |
| Leu | CUA | 87619 | 13.4 |
| Leu | CUG | 68494 | 10.5 |
| Total | | | |
| Ile | AUU | 196893 | 30.1 |
| Ile | AUC | 112176 | 17.2 |
| Ile | AUA | 116254 | 17.8 |
| Total | | | |
| Met | AUG | 136805 | 20.9 |
| Total | | | |
| Val | GUU | 144243 | 22.1 |
| Val | GUC | 76947 | 11.8 |
| Val | GUA | 76927 | 11.8 |
| Val | GUG | 70337 | 10.8 |
| Total | | | |
| Ser | UCU | 153557 | 23.5 |
| Ser | UCC | 92923 | 14.2 |
| Ser | UCA | 122028 | 18.7 |
| Ser | UCG | 55951 | 8.6 |
| Ser | AGU | 92466 | 14.2 |
| Ser | AGC | 63726 | 9.8 |
| Total | | | |
| Pro | CCU | 88263 | 13.5 |
| Pro | CCC | 44309 | 6.8 |
| Pro | CCA | 119641 | 18.3 |
| Pro | CCG | 34597 | 5.3 |
| Total | | | |
| Thr | ACU | 132522 | 20.3 |
| Thr | ACC | 83207 | 12.7 |
| Thr | ACA | 116084 | 17.8 |
| Thr | ACG | 52045 | 8.0 |
| Total | | | |
| Ala | GCU | 138358 | 21.2 |
| Ala | GCC | 82357 | 12.6 |
| Ala | GCA | 105910 | 16.2 |
| Ala | GCG | 40358 | 6.2 |
| Total | | | |
| Tyr | UAU | 122728 | 18.8 |
| Tyr | UAC | 96596 | 14.8 |
| Total | | | |
| His | CAU | 89007 | 13.6 |
| His | CAC | 50785 | 7.8 |
| Total | | | |
| Gln | CAA | 178251 | 27.3 |
| Gln | CAG | 79121 | 12.1 |
| Total | | | |
| Asn | AAU | 233124 | 35.7 |
| Asn | AAC | 162199 | 24.8 |
| Total | | | |
| Lys | AAA | 273618 | 41.9 |
| Lys | AAG | 201361 | 30.8 |
| Total | | | |
| Asp | GAU | 245641 | 37.6 |
| Asp | GAC | 132048 | 20.2 |
| Total | | | |
| Glu | GAA | 297944 | 45.6 |
| Glu | GAG | 125717 | 19.2 |
| Total | | | |
| Cys | UGU | 52903 | 8.1 |
| Cys | UGC | 31095 | 4.8 |
| Total | | | |
| Trp | UGG | 67789 | 10.4 |
| Total | | | |
| Arg | CGU | 41791 | 6.4 |
| Arg | CGC | 16993 | 2.6 |
| Arg | CGA | 19562 | 3.0 |
| Arg | CGG | 11351 | 1.7 |
| Arg | AGA | 139081 | 21.3 |
| Arg | AGG | 60289 | 9.2 |
| Total | | | |
| Gly | GGU | 156109 | 23.9 |
| Gly | GGC | 63903 | 9.8 |
| Gly | GGA | 71216 | 10.9 |
| Gly | GGG | 39359 | 6.0 |

TABLE 2-continued

Codon Usage Table for *Saccharomyces cerevisiae* Genes

| Amino Acid | Codon | Number | Frequency per hundred |
|---|---|---|---|
| Total | | | |
| Stop | UAA | 6913 | 1.1 |
| Stop | UAG | 3312 | 0.5 |
| Stop | UGA | 4447 | 0.7 |

By utilizing this or similar Tables, one of ordinary skill in the art can apply the frequencies to any given polypeptide sequence, and produce a nucleic acid fragment of a codon-optimized coding region which encodes the polypeptide, but which uses codons optimal for a given species. Codon-optimized coding regions can be designed by various different methods.

In one method, a codon usage Table is used to find the single most frequent codon used for any given amino acid, and that codon is used each time that particular amino acid appears in the polypeptide sequence. For example, referring to Table 2 above, for leucine, the most frequent codon is UUG, which is used 27.2% of the time. Thus all the leucine residues in a given amino acid sequence would be assigned the codon UUG.

In another method, the actual frequencies of the codons are distributed randomly throughout the coding sequence. Thus, using this method for optimization, if a hypothetical polypeptide sequence had 100 leucine residues, referring to Table 2 for frequency of usage in the *S. cerevisiae*, about 5, or 5% of the leucine codons would be CUC, about 11, or 11% of the leucine codons would be CUG, about 12, or 12% of the leucine codons would be CUU, about 13, or 13% of the leucine codons would be CUA, about 26, or 26% of the leucine codons would be UUA, and about 27, or 27% of the leucine codons would be UUG.

These frequencies would be distributed randomly throughout the leucine codons in the coding region encoding the hypothetical polypeptide. As will be understood by those of ordinary skill in the art, the distribution of codons in the sequence can vary significantly using this method; however, the sequence always encodes the same polypeptide.

When using the methods above, the term "about" is used precisely to account for fractional percentages of codon frequencies for a given amino acid. As used herein, "about" is defined as one amino acid more or one amino acid less than the value given. The whole number value of amino acids is rounded up if the fractional frequency of usage is 0.50 or greater, and is rounded down if the fractional frequency of use is 0.49 or less. Using again the example of the frequency of usage of leucine in human genes for a hypothetical polypeptide having 62 leucine residues, the fractional frequency of codon usage would be calculated by multiplying 62 by the frequencies for the various codons. Thus, 7.28 percent of 62 equals 4.51 UUA codons, or "about 5," i.e., 4, 5, or 6 UUA codons, 12.66 percent of 62 equals 7.85 UUG codons or "about 8," i.e., 7, 8, or 9 UUG codons, 12.87 percent of 62 equals 7.98 CUU codons, or "about 8," i.e., 7, 8, or 9 CUU codons, 19.56 percent of 62 equals 12.13 CUC codons or "about 12," i.e., 11, 12, or 13 CUC codons, 7.00 percent of 62 equals 4.34 CUA codons or "about 4," i.e., 3, 4, or 5 CUA codons, and 40.62 percent of 62 equals 25.19 CUG codons, or "about 25," i.e., 24, 25, or 26 CUG codons.

Randomly assigning codons at an optimized frequency to encode a given polypeptide sequence, can be done manually by calculating codon frequencies for each amino acid, and then assigning the codons to the polypeptide sequence randomly. Additionally, various algorithms and computer software programs are readily available to those of ordinary skill in the art. For example, the "EditSeq" function in the Lasergene Package, available from DNAstar, Inc., Madison, Wis., the backtranslation function in the VectorNTI Suite, available from InforMax, Inc., Bethesda, Md., and the "backtranslate" function in the GCG-Wisconsin Package, available from Accelrys, Inc., San Diego, Calif. In addition, various resources are publicly available to codon-optimize coding region sequences, e.g., the "backtranslation" function at http://www.entelechon.com/2008/10/backtranslation-tool/ (visited Aug. 24, 2012). Constructing a rudimentary algorithm to assign codons based on a given frequency can also easily be accomplished with basic mathematical functions by one of ordinary skill in the art.

A number of options are available for synthesizing codon optimized coding regions designed by any of the methods described above, using standard and routine molecular biological manipulations well known to those of ordinary skill in the art. In one approach, a series of complementary oligonucleotide pairs of 80-90 nucleotides each in length and spanning the length of the desired sequence is synthesized by standard methods. These oligonucleotide pairs are synthesized such that upon annealing, they form double stranded fragments of 80-90 base pairs, containing cohesive ends, e.g., each oligonucleotide in the pair is synthesized to extend 3, 4, 5, 6, 7, 8, 9, 10, or more bases beyond the region that is complementary to the other oligonucleotide in the pair. The single-stranded ends of each pair of oligonucleotides are designed to anneal with the single-stranded end of another pair of oligonucleotides. The oligonucleotide pairs are allowed to anneal, and approximately five to six of these double-stranded fragments are then allowed to anneal together via the cohesive single stranded ends, and then they ligated together and cloned into a standard bacterial cloning vector, for example, a TOPO® vector available from Invitrogen Corporation, Carlsbad, Calif. The construct is then sequenced by standard methods. Several of these constructs consisting of 5 to 6 fragments of 80 to 90 base pair fragments ligated together, i.e., fragments of about 500 base pairs, are prepared, such that the entire desired sequence is represented in a series of plasmid constructs. The inserts of these plasmids are then cut with appropriate restriction enzymes and ligated together to form the final construct. The final construct is then cloned into a standard bacterial cloning vector, and sequenced. Additional methods would be immediately apparent to the skilled artisan. In addition, gene synthesis is readily available commercially.

In certain embodiments, an entire polypeptide sequence, or fragment, variant, or derivative thereof is codon optimized by any of the methods described herein. Various desired fragments, variants or derivatives are designed, and each is then codon-optimized individually. In addition, partially codon-optimized coding regions of the present invention can be designed and constructed. For example, the invention includes a nucleic acid fragment of a codon-optimized coding region encoding a polypeptide in which at least about 1%, at least about 2%, at least about 3%, at least about 4%, at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or 100% of the codon positions have been codon-optimized for a given species, or any range of values thereof. That is, they contain a codon that is preferentially used in the genes of a desired species, e.g., a yeast species such as *Saccharomyces cerevisiae* or *Kluyveromyces*, in place of a codon that is normally used in the native nucleic acid sequence.

In additional embodiments, a full-length polypeptide sequence is codon-optimized for a given species resulting in a codon-optimized coding region encoding the entire polypeptide, and then nucleic acid fragments of the codon-optimized coding region, which encode fragments, variants, and derivatives of the polypeptide are made from the original codon-optimized coding region. As would be well understood by those of ordinary skill in the art, if codons have been randomly assigned to the full-length coding region based on their frequency of use in a given species, nucleic acid fragments encoding fragments, variants, and derivatives would not necessarily be fully codon optimized for the given species. However, such sequences are still much closer to the codon usage of the desired species than the native codon usage. The advantage of this approach is that synthesizing codon-optimized nucleic acid fragments encoding each fragment, variant, and derivative of a given polypeptide, although routine, would be time consuming and would result in significant expense.

The codon-optimized coding regions can be, for example, versions encoding an endoglucanase, glucosidase, cellobiohydrolase, xylanase, glucanase, xylosidase, xylan esterase, arabinofuranosidase, galactosidase, cellobiose phosphorylase, cellodextrin phosphorylase, mannanase, mannosidase, xyloglucanase, endoxylanase, glucuronidase, acetylxylanesterase, arabinofuranohydrolase, swollenin, glucuronyl esterase, expansin, pectinase, feruoyl esterase, alpha-amylase, beta-amylase, glucoamylase, pullulanase, isopullulanase, alpha-glucosidase, beta-glucosidase, galactosidase, arabinase, arabinoxylanase, arabinosidase, arabinofuranosidase, arabinoxylanase, arabinosidase, arabinofuranosidase, arabinose isomerase, ribulose-5-phosphate 4-epimerase, xylose isomerase, xylulokinase, xylose reductase, xylose dehydrogenase, xylitol dehydrogenase, xylonate dehydratase, xylose transketolase, and/or xylose transaldolase as disclosed herein, or domains, fragments, variants, or derivatives thereof.

Codon optimization is carried out for a particular species by methods described herein, for example, in certain embodiments codon-optimized coding regions encoding polypeptides disclosed in the present application or domains, fragments, variants, or derivatives thereof are optimized according to yeast codon usage, e.g., *Saccharomyces cerevisiae, Kluyveromyces lactis*, and/or *Kluyveromyces marxianus*. Also provided are polynucleotides, vectors, and other expression constructs comprising codon-optimized coding regions encoding polypeptides disclosed herein, or domains, fragments, variants, or derivatives thereof, and various methods of using such polynucleotides, vectors, and other expression constructs.

In certain embodiments described herein, a codon-optimized coding region encoding a sequence disclosed herein, or domain, fragment, variant, or derivative thereof, is optimized according to codon usage in yeast (e.g., *Saccharomyces cerevisiae, Kluyveromyces lactis*, or *Kluyveromyces marxianus*). In some embodiments, the sequences are codon-optimized specifically for expression in *Saccharomyces cerevisiae*. Alternatively, a codon-optimized coding region encoding a sequence disclosed herein can be optimized according to codon usage in any plant, animal, or microbial species.

Vectors and Methods of Using Vectors in Host Cells

In another aspect, the present invention relates to vectors which include polynucleotides of the present invention, host cells which are genetically engineered with vectors of the invention, and the production of polypeptides of the invention by recombinant techniques.

Host cells can be genetically engineered (transduced or transformed or transfected) with vectors of the invention which can be, for example, a cloning vector or an expression vector. The vector can be, for example, in the form of a plasmid, a viral particle, or a phage. The engineered host cells can be cultured in conventional nutrient media modified as appropriate for activating promoters, selecting transformants, or amplifying the genes of the present invention. The culture conditions, such as temperature, pH, and the like, are those previously used with the host cell selected for expression, and will be apparent to the ordinarily skilled artisan.

The polynucleotides of the present invention can be employed for producing polypeptides by recombinant techniques. Thus, for example, the polynucleotides can be included in any one of a variety of expression vectors for expressing a polypeptide. Such vectors include chromosomal, nonchromosomal, and synthetic DNA sequences, e.g., derivatives of SV40; bacterial plasmids; and yeast plasmids. However, any other vector can be used as long as it is replicable and viable in the host.

The appropriate DNA sequence can be inserted into the vector by a variety of procedures. In general, the DNA sequence is inserted into an appropriate restriction endonuclease site(s) by procedures known in the art. Such procedures and others are deemed to be within the scope of those skilled in the art, and include, for example, yeast mediated ligation (Shanks, R. M. Q., Caiazza, N. C., Hinsa, S. M., Toutain, C. M., & O'Toole, G. a., *Saccharomyces cerevisiae*-based molecular tool kit for manipulation of genes from gram-negative bacteria. Applied and environmental microbiology, 72(7), 5027-36 (2006)).

The DNA sequence in the expression vector is operatively associated with an appropriate expression control sequence(s) (promoter) to direct mRNA synthesis. Representative examples of such promoters are as follows:

TABLE 3

Promoter examples.

| Gene | Organism | Systematic name | Reason for use/benefits |
|---|---|---|---|
| PGK1 | S. cerevisiae | YCR012W | Strong constitutive promoter |
| ENO1 | S. cerevisiae | YGR254W | Strong constitutive promoter |
| TDH3 | S. cerevisiae | YGR192C | Strong constitutive promoter |
| TDH2 | S. cerevisiae | YJR009C | Strong constitutive promoter |
| TDH1 | S. cerevisiae | YJL052W | Strong constitutive promoter |
| ENO2 | S. cerevisiae | YHR174W | Strong constitutive promoter |
| GPM1 | S. cerevisiae | YKL152C | Strong constitutive promoter |
| TPI1 | S. cerevisiae | YDR050C | Strong constitutive promoter |

Additionally, promoter sequences from stress and starvation response genes are useful in the present invention. In some embodiments, promoter regions from the *S. cerevisiae* genes GAC1, GET3, GLC7, GSH1, GSH2, HSF1, HSP12, LCB5, LRE1, LSP1, NBP2, PDC1, PIL1, PIM1, SGT2, SLG1, WHI2, WSC2, WSC3, WSC4, YAP1, YDC1, HSP104, HSP26, ENA1, MSN2, MSN4, SIP2, SIP4, SIP5, DPL1, IRS4, KOG1, PEP4, HAP4, PRB1, TAX4, ZPR1, ATG1, ATG2, ATG10, ATG11, ATG12, ATG13, ATG14, ATG15, ATG16, ATG17, ATG18, ATG19, PFK1, ADH1, HXT7, or FBA1 can be used. Any suitable promoter to drive gene expression in the host cells of the invention can be used. Additionally, the *E. coli*, lac, or trp, and other promoters known to control expression of genes in prokaryotic or lower eukaryotic cells can be used.

In addition, the expression vectors can contain one or more selectable marker genes to provide a phenotypic trait for selection of transformed host cells such as URA3, HIS3, LEU2, TRP1, LYS2, ADE2, dihydrofolate reductase, neomycin (G418) resistance, or zeocin resistance for eukaryotic cell culture, or tetracycline or ampicillin resistance in *E. coli*.

The expression vector can also contain a ribosome binding site for translation initiation, and/or a transcription terminator. The vector can also include appropriate sequences for amplifying expression, or can include additional regulatory regions.

The expression vector containing the appropriate DNA sequence as disclosed herein, as well as an appropriate promoter or control sequence, can be employed to transform an appropriate host to permit the host to express a protein.

In some embodiments, the expression vector is selected from pMU3150, pMU3151, pMU3217, pMU3218, pMU3152, pMU3153, pMU3154, pMU3155, pMU3156, pMU3157, pMU3219, pMU3158, pMU3159, pMU3220, pMU3160, pMU3221, pMU3222, pMU3161, pMU3162, pMU3163, pMU3223, pMU3164, pMU3165, pMU3224, pMU3166, pMU3167, pMU3129, pMU3168, pMU3169, pMU3170, pMU3130, pMU3131, pMU3132, pMU3133, pMU3134, pMU3135, pMU3136, pMU3171, pMU3172, pMU3173, pMU3174, pMU3175, pMU3137, pMU3138, pMU3139, pMU2981, pMU2659, pMU2877, pMU2745, pMU2746, pMU2873 and pMU2879. In some embodiments, the expression vector comprises one or more sequence selected from SEQ ID NOs:347-358, 447-489 or 577-581, or a sequence having at least about 90%, 95%, 96%, 97%, 98% or 99% identity thereof.

Thus, in certain aspects, the present invention relates to host cells containing the above-described constructs. The host cell can be a host cell as described elsewhere in the application. The host cell can be, for example, a lower eukaryotic cell, such as a yeast cell, e.g., *Saccharomyces cerevisiae* or *Kluyveromyces*, or the host cell can be a prokaryotic cell, such as a bacterial cell.

Representative examples of appropriate hosts include bacterial cells, such as *E. coli, Streptomyces, Salmonella typhimurium*; thermophilic or mesophilic bacteria; fungal cells, such as yeast; and plant cells. The selection of an appropriate host is deemed to be within the scope of those skilled in the art from the teachings herein.

Appropriate fungal hosts include yeast. In certain aspects of the invention, the yeast is selected from *Saccharomyces cerevisiae, Kluyveromyces lactis, Schizosaccharomyces pombe, Candida albicans, Pichia pastoris, Pichia stipitis, Yarrowia lipolytica, Hansenula polymorpha, Phaffia rhodozyma, Candida utilis, Arxula adeninivorans, Debaryomyces hansenii, Debaryomyces polymorphus, Schwanniomyces occidentalis, Issatchenkia orientalis, Kluyveromyces marxianus, Blakeslea, Candida, Cryptococcus, Cunninghamella, Lipomyces, Mortierella, Mucor, Phycomces, Pythium, Rhodosporidium, Rhodotorula, Trichosporon*, or *Yarrowia*.

Methods of Using Host Cells to Produce Ethanol or Other Fermentation Products

In another aspect, the present invention is directed to the use of host cells and co-cultures to produce ethanol or other products from a biomass feedstock comprising starch, lignocellulosic matter, hexose, and/or pentose sugars. Such methods can be accomplished, for example, by contacting a biomass feedstock with a host cell or a co-culture of the present invention, allowing the recombinant host cell to ferment the lignocellulosic material, and recovering the fermentation product. Fermentation products include, but are not limited to, products such as butanol, acetate, amino acids, and vitamins.

Numerous biomass feedstocks can be used in accordance with the present invention. Substrates for saccharolytic enzyme activity assays can be divided into two categories, soluble and insoluble, based on their solubility in water. Soluble substrates include alpha-dextrins, cellodextrins or derivatives, carboxymethyl cellulose (CMC), or hydroxyethyl cellulose (HEC). Insoluble substrates include insoluble starch, crystalline cellulose, microcrystalline cellulose (Avicel), amorphous cellulose, such as phosphoric acid swollen cellulose (PASC), dyed or fluorescent cellulose, and lignocellulosic biomass. These substrates are generally highly ordered cellulosic material, and thus are only sparingly soluble.

It will be appreciated that suitable lignocellulosic material can be any feedstock that contains soluble and/or insoluble cellulose, where the insoluble cellulose can be in a crystalline or non-crystalline form. In various embodiments, the lignocellulosic biomass comprises, for example, wood, corn, corn stover, sawdust, bark, leaves, agricultural and forestry residues, grasses such as switchgrass, ruminant digestion products, municipal wastes, paper mill effluent, newspaper, cardboard, or combinations thereof. In other embodiments, lignocellulosic material comprises insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, agave, or combinations thereof.

In some embodiments, the invention is directed to a method for hydrolyzing a biomass feedstock, for example, a biomass feedstock as described above, by contacting the biomass feedstock with a host cell of the invention. In some embodiments, the invention is directed to a method for hydrolyzing a biomass feedstock, for example, a biomass feedstock as described above, by contacting the feedstock with a co-culture comprising yeast cells expressing heterologous saccharolytic enzymes.

In some embodiments of the present invention, the necessity of adding external saccharolytic enzymes to the fermentation medium is reduced because cells of the invention express polypeptides of the invention.

In some embodiments, the invention is directed to a method for fermenting a biomass feedstock. Such methods can be accomplished, for example, by culturing a host cell or co-culture in a medium that contains insoluble biomass feedstock to allow saccharification and fermentation of the biomass feedstock.

In addition to the enzymes of the present invention, in some embodiments, host cells of the present invention can have further genetic modifications to make them more suitable for fermenting biomass feedstock to ethanol. For example, host cells of the present invention can express xylose isomerase and/or arabinose isomerase in order to more efficiently use pentose sugars for fermentation. In some embodiments, the xylose isomerase is from a *Piromyces* species. In addition to a xylose isomerase, host cells of the invention, in some embodiments, can over-express genes related to the pentose phosphate pathway. These genes include, but are not limited to transkelolase and transaldolase genes. Components of the pentose phosphate pathway are known to those skilled in the art and are useful in aiding assimilation of carbons derived from pentose sugars into fermentation processes. (See, e.g., Intl Pub. Nos. WO03/062430 and WO06/009434, and U.S. Pub. No. 2006/0234364, which are incorporated by reference herein). In some embodiments, a host cell is able to use xylose and other pentose sugars such as arabinose by incorporating the carbons from pentose sugars into fermentative pathways via the pentose phosphate pathway. The xylose-utilizing host cell heterologously expresses xylose isomerase, e.g. *Piromyces* sp. E2 XylA, overexpresses xylulokinase, ribulose 5-phosphate isomerase, ribulose 5-phosphate epimerase, transketolase and transaldolase, and does not express an aldose reductase such as the GRE3 gene (encoding an aldose reductase).

In some embodiments, the fermentation product is selected from ethanol, lactic acid, hydrogen, butyric acid, acetone, and butanol.

The production of ethanol can, according to the present invention, be performed at temperatures of at least about 25° C., at least about 28° C., at least about 30° C., at least about 31° C., at least about 32° C., at least about 33° C., at least about 34° C., at least about 35° C., at least about 36° C., at least about 37° C., at least about 38° C., at least about 39° C., at least about 40° C., at least about 41° C., at least about 42° C., or at least about 50° C. In some embodiments of the present invention, the thermotolerant host cell can produce ethanol from cellulose at temperatures above about 30° C., above about 31° C., above about 32° C., above about 33° C., above about 34° C., above about 35° C., above about 36° C., above about 37° C., above about 38° C., above about 39° C., above about 40° C., above about 41° C., above about 42° C., or above about 50° C. In some embodiments of the present invention, the thermotolerant host cell can produce ethanol from cellulose at temperatures from about 30° C. to about 60° C., about 30° C. to about 55° C., about 30° C. to about 50° C., about 40° C. to about 60° C., about 40° C. to about 55° C., or about 40° C. to about 50° C.

In some embodiments, methods of producing ethanol can comprise contacting a biomass feedstock with a host cell or co-culture of the invention and additionally contacting the biomass feedstock with externally produced saccharolytic enzymes. Exemplary externally produced saccharolytic enzymes are commercially available and are known to those of skill in the art and are further exemplified below.

Therefore, the invention is also directed to methods of reducing the amount of externally produced saccharolytic enzymes required to produce a given amount of ethanol from the biomass feedstock comprising contacting the saccharolytic enzyme with externally produced saccharolytic enzymes and with a host cell or co-culture of the invention. In some embodiments, the same amount of ethanol production can be achieved using at least about 5%, at least about 10%, at least about 15%, at least about 20%, at least about 25%, at least about 30%, at least about 50%, or at least about 100% fewer externally produced saccharolytic enzymes, or any range of values thereof.

In some embodiments, the methods comprise producing ethanol at a particular rate. For example, in some embodiments, ethanol is produced at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20 mg per hour per liter, at least about 25 mg per hour per liter, at least about 30 mg per hour per liter, at least about 50 mg per hour per liter, at least about 100 mg per hour per liter, at least about 200 mg per hour per liter, at least about 500 mg per hour per liter, or any range of values thereof.

In some embodiments, the host cells of the present invention can produce ethanol at a rate of at least about 0.1 mg per hour per liter, at least about 0.25 mg per hour per liter, at least about 0.5 mg per hour per liter, at least about 0.75 mg per hour per liter, at least about 1.0 mg per hour per liter, at least about 2.0 mg per hour per liter, at least about 5.0 mg per hour per liter, at least about 10 mg per hour per liter, at least about 15 mg per hour per liter, at least about 20.0 mg per hour per liter, at least about 25 mg per hour per liter, at least about 30 mg per hour per liter, at least about 50 mg per hour per liter, at least about 100 mg per hour per liter, at least about 200 mg per hour per liter, or at least about 500 mg per hour per liter more than a control strain (lacking heterologous biomass feedstock hydrolyzing enzymes) and grown under the same conditions, or any range of values thereof. In some embodiments, the ethanol can be produced in the absence of any externally added saccharolytic enzymes and/or acid hydrolysis.

In some embodiments, the recombinant microorganism produces about 2 to about 3 times more ethanol than a wildtype, non-recombinant organism; at least about 1.5 to at least about 2 times more ethanol than a wildtype, non-recombinant organism; at least about 1.5 to at least about 5 times more ethanol than a wildtype, non-recombinant organism; at least about 1.5 to at least about 7 times more ethanol than a wildtype, non-recombinant organism; at least about 1.5 to at least about 10 times more ethanol than a wildtype, non-recombinant organism; at least about 1.5 to at least about 15 times more ethanol than a wildtype, non-recombinant organism; at least about 1.5 to at least about 20 times more ethanol than a wildtype, non-recombinant organism; at least about 1.5 to at least about 30 times more ethanol than a wildtype, non-recombinant organism; at least about 1.5 to at least about 50 times more ethanol than a wildtype, non-recombinant organism; at least about 1.5 to at least about 75 times more ethanol than a wildtype, non-recombinant organism; or at least about 1.5 to at least about 100 times more ethanol than a wildtype, non-recombinant organism.

In some embodiments, the recombinant microorganism produces at least about 0.5 g/L ethanol to at least about 2 g/L ethanol, at least about 0.5 g/L ethanol to at least about 3 g/L ethanol, at least about 0.5 g/L ethanol to at least about 5 g/L ethanol, at least about 0.5 g/L ethanol to at least about 7 g/L ethanol, at least about 0.5 g/L ethanol to at least about 10 g/L ethanol, at least about 0.5 g/L ethanol to at least about 15 g/L ethanol, at least about 0.5 g/L ethanol to at least about 20 g/L ethanol, at least about 0.5 g/L ethanol to at least about 30 g/L ethanol, at least about 0.5 g/L ethanol to at least about 40 g/L ethanol, at least about 0.5 g/L ethanol to at least about 50 g/L ethanol, at least about 0.5 g/L ethanol to at least about 75 g/L ethanol, or at least about 0.5 g/L ethanol to at least about 99 g/L ethanol per 24 hour incubation on a carbon-containing feed stock.

In some embodiments, the recombinant microorganism produces ethanol at least about 55% to at least about 75% of theoretical yield, at least about 50% to at least about 80% of theoretical yield, at least about 45% to at least about 85% of theoretical yield, at least about 40% to at least about 90% of theoretical yield, at least about 35% to at least about 95% of theoretical yield, at least about 30% to at least about 99% of theoretical yield, or at least about 25% to at least about 99% of theoretical yield.

Ethanol production can be measured using any method known in the art. For example, the quantity of ethanol in fermentation samples can be assessed using HPLC analysis. Many ethanol assay kits are commercially available that use, for example, alcohol oxidase enzyme based assays. Methods of determining ethanol production are within the scope of those skilled in the art from the teachings herein.

Synergistic Activity of Saccharolytic Enzymes

In some embodiments, the expression of two or more enzymes of the present invention results in synergistic enzymatic activity with respect to substrate digestion. For example, the presence of two distinct paralogs or orthologs containing the same enzymatic activity can significantly enhance the digestion of a substrate compared to a comparable amount of either enzyme by itself. Alternatively, synergistically acting enzymes do not need to have exactly identical chemical activity, but can still operate to liberate sugars in a capacity greater than either is capable of individually. Without wishing to be bound by a particular theory, it is thought that although the catalytic activity of the enzymes can be the same, the different characteristics of the enzymes with respect to the regions surrounding the chemical substrate as well as other differing properties of the enzymes aid in digesting the varied biomass feedstock components. In some embodiments, enzymatic synergy allows biomass feedstock digestion and fermentation to take place using reduced amounts of external saccharolytic enzymes. In some embodiments, the two or more enzymes acting synergistically are endoglucanases, glucosidases, cellobiohydrolases, xylanases, glucanases, xylosidases, xylan esterases, arabinofuranosidases, galactosidases, cellobiose phosphorylases, cellodextrin phosphorylases, mannanases, mannosidases, xyloglucanases, endoxylanases, glucuronidases, acetylxylanesterases, arabinofuranohydrolases, swollenins, glucuronyl esterases, expansins, pectinases, feruoyl esterases, alpha-amylases, beta-amylases, glucoamylases, pullulanases, isopullulanases, alpha-glucosidases, beta-glucosidases, galactosidases, arabinases, arabinoxylanases, arabinosidases, arabinofuranosidases, arabinoxylanases, arabinosidases, arabinose isomerases, ribulose-5-phosphate 4-epimerases, xylose isomerases, xylulokinases, xylose reductases, xylose dehydrogenases, xylitol dehydrogenases, xylonate dehydratases, xylose transketolases, and/or xylose transaldolases as disclosed herein. In some embodiments, the two or more enzymes acting synergistically do not have the same enzymatic activity. In other embodiments, the two or more enzymes acting synergistically have the same enzyme activity.

In other embodiments, enzymatic synergy is achieved by expressing 3, 4, 5, 6, 7, or more enzymes with the same catalytic activity.

In some embodiments, enzymatic synergy is achieved with a recombinant host cell of the invention comprising (a) a heterologous polynucleotide comprising a nucleic acid which encodes an acetylxylanesterase; (b) a heterologous polynucleotide comprising a nucleic acid which encodes a xylanase; and (c) a heterologous polynucleotide comprising a nucleic acid which encodes a xylosidase. In some embodiments, the recombinant host cell further comprises (d) a heterologous polynucleotide comprising a nucleic acid which encodes a galactosidase. In some embodiments, the recombinant host cell further comprises (e) a heterologous polynucleotide comprising a nucleic acid which encodes a mannosidase or a heterologous polynucleotide comprising a nucleic acid which encodes an alpha-glucuronidase.

Glycerol Reduction

Non-limiting examples of glycerol deletion strains are described in Int'l App. No. PCT/US2012/032443, U.S. application Ser. No. 13/696,207, U.S. Publ. No. 2012/0322078 and U.S. Provisional Appl. No. 61/728,450, which are incorporated herein by reference in their entirety.

Anaerobic growth conditions require the production of endogenous electron acceptors, such as the coenzyme nicotinamide adenine dinucleotide ($NAD^+$). In cellular redox reactions, the $NAD^+$/NADH couple plays a vital role as a reservoir and carrier of reducing equivalents. Ansell, R., et al., EMBO J. 16:2179-87 (1997). Cellular glycerol production, which generates an $NAD^+$, serves as a redox valve to remove excess reducing power during anaerobic fermentation in yeast. Glycerol production is, however, an energetically wasteful process that expends ATP and results in the loss of a reduced three-carbon compound. Ansell, R., et al., *EMBO J.* 16:2179-87 (1997). To generate glycerol from a starting glucose molecule, glycerol 3-phosphate dehydrogenase (GPD) reduces dihydroxyacetone phosphate to glycerol 3-phosphate and glycerol 3-phosphatase (GPP) dephosphorylates glycerol 3-phosphate to glycerol. Despite being energetically wasteful, glycerol production is a necessary metabolic process for anaerobic growth as deleting GPD activity completely inhibits growth under anaerobic conditions. See Ansell, R., et al., *EMBO J.* 16:2179-87 (1997).

GPD is encoded by two isogenes, gpd1 and gpd2. GPD1 encodes the major isoform in anaerobically growing cells, while GPD2 is required for glycerol production in the absence of oxygen, which stimulates its expression. Pahlman, A-K., et al., *J. Biol. Chem.* 276:3555-3563 (2001). The first step in the conversion of dihydroxyacetone phosphate to glycerol by GPD is rate controlling. Guo, Z. P., et al., Metab. Eng. 13:49-59 (2011). GPP is also encoded by two isogenes, gpp1 and gpp2. The deletion of GPP genes arrests growth when shifted to anaerobic conditions, demonstrating that GPP is important for cellular tolerance to osmotic and anaerobic stress. See Pahlman, A-K., et al., *J. Biol. Chem.* 276:3555-3563 (2001).

Because glycerol is a major by-product of anaerobic production of ethanol, many efforts have been made to delete cellular production of glycerol. However, because of the reducing equivalents produced by glycerol synthesis, deletion of the glycerol synthesis pathway cannot be done without compensating for this valuable metabolic function. Attempts to delete glycerol production and engineer alternate electron acceptors have been made. Lidén, G., et al.,

*Appl. Env. Microbiol.* 62:3894-96 (1996); Medina, V. G., et al., *Appl. Env. Microbiol.* 76:190-195 (2010). Lidén and Medina both deleted the gpd1 and gpd2 genes and attempted to bypass glycerol formation using additional carbon sources. Lidén engineered a xylose reductase from *Pichia stipitis* into an *S. cerevisiae* gpd1/2 deletion strain. The xylose reductase activity facilitated the anaerobic growth of the glycerol-deleted strain in the presence of xylose. See Lidén, G., et al., *Appl. Env. Microbiol.* 62:3894-96 (1996). Medina engineered an acetylaldehyde dehydrogenase, mhpF, from *E. coli* into an *S. cerevisiae* gpd1/2 deletion strain to convert acetyl-CoA to acetaldehyde. The acetylaldehyde dehydrogenase activity facilitated the anaerobic growth of the glycerol-deletion strain in the presence of acetic acid but not in the presence of glucose as the sole source of carbon. Medina, V. G., et al., *Appl. Env. Microbiol.* 76:190-195 (2010); see also EP Pub. No. 2277989. Medina noted several issues with the mhpF-containing strain that needed to be addressed before implementing industrially, including significantly reduced growth and product formation rates than yeast comprising GPD1 and GPD2.

Additional attempts to redirect flux from glycerol to ethanol have included the engineering of a non-phosphorylating NADP+-dependent glyceraldehydes-3-phosphate dehydrogenase (GAPN) into yeast, either with or without the simultaneous knockout of GPD1. Bro, C., et al., *Metab. Eng.* 8:102-111 (2006); U.S. Patent Appl. Pub. No. US2006/0257983; Guo, Z. P., et al., *Metab. Eng.* 13:49-59 (2011). However, other cellular mechanisms exist to control the production and accumulation of glycerol, including glycerol exporters such as FPS1, that do not require the engineering of alternate NADP+/NADPH coupling or deletion of glycerol synthesis genes. Támas, M. J., et al., *Mol. Microbiol.* 31:1087-1004 (1999).

FPS1 is a channel protein located in the plasma membrane that controls the accumulation and release of glycerol in yeast osmoregulation. Null mutants of this strain accumulate large amounts of intracellular glycerol, grow much slower than wild-type, and consume the sugar substrate at a slower rate. Támas, M. J., et al., *Mol. Microbiol.* 31:1087-1004 (1999). Despite slower growth under anaerobic conditions, an fps1Δ strain can serve as an alternative to eliminating NAD$^+$-dependent glycerol activity. An fps1Δ strain has reduced glycerol formation yet has a completely functional NAD$^+$-dependent glycerol synthesis pathway. Alternatively, rather than deleting endogenous FPS1, constitutively active mutants of FPS1 or homologs from other organisms can be used to regulate glycerol synthesis while keep the NAD$^+$-dependent glycerol activity intact. In embodiments of the invention that modulate FPS1, the recombinant host cells can still synthesize and retain glycerol and achieve improved robustness relative to strains that are unable to make glycerol.

In embodiments, one or more endogenous glycerol-producing or regulating genes are deleted to create yeast strains with altered glycerol production. In other embodiments, one or more endogenous glycerol-producing genes are downregulated to create yeast strains with altered glycerol production. In still other embodiments, one or more endogenous glycerol-regulating genes are downregulated to create yeast strains with altered glycerol production. In yet other embodiments, one or more endogenous glycerol-regulating genes are downregulated to create yeast strains with altered glycerol production. In embodiments, glycerol production in such yeast strains is downregulated in comparison with wild type yeast cell. In some embodiments, GPD1 is downregulated.

Xylose Metabolism

Xylose is a five-carbon monosaccharide that can be metabolized into useful products by a variety of organisms. There are two main pathways of xylose metabolism, each unique in the characteristic enzymes they utilize. One pathway is called the "Xylose Reductase-Xylitol Dehydrogenase" or XR-XDH pathway. Xylose reductase (XR) and xylitol dehydrogenase (XDH) are the two main enzymes used in this method of xylose degradation. XR, encoded by the XYL1 gene, is responsible for the reduction of xylose to xylitol and is aided by cofactors NADH or NADPH. Xylitol is then oxidized to xylulose by XDH, which is expressed through the XYL2 gene, and accomplished exclusively with the cofactor NAD$^+$. Because of the varying cofactors needed in this pathway and the degree to which they are available for usage, an imbalance can result in an overproduction of xylitol byproduct and an inefficient production of desirable ethanol. Varying expression of the XR and XDH enzyme levels have been tested in the laboratory in the attempt to optimize the efficiency of the xylose metabolism pathway.

The other pathway for xylose metabolism is called the "Xylose Isomerase" (XI) pathway. Enzyme XI is responsible for direct conversion of xylose into xylulose, and does not proceed via a xylitol intermediate. Both pathways create xylulose, although the enzymes utilized are different. After production of xylulose both the XR-XDH and XI pathways proceed through the enzyme xylulokinase (XK), encoded on gene XKS 1, to further modify xylulose into xylulose-5-phosphate where it then enters the pentose phosphate pathway for further catabolism.

Studies on flux through the pentose phosphate pathway during xylose metabolism have revealed that limiting the speed of this step can be beneficial to the efficiency of fermentation to ethanol. Modifications to this flux that can improve ethanol production include (a) lowering phosphoglucose isomerase activity, (b) deleting the GND1 gene, and (c) deleting the ZWF1 gene (Jeppsson et al., *Appl. Environ. Microbiol.* 68:1604-09 (2002)). Since the pentose phosphate pathway produces additional NADPH during metabolism, limiting this step will help to correct the already evident imbalance between NAD(P)H and NAD$^+$ cofactors and reduce xylitol byproduct. Another experiment comparing the two xylose metabolizing pathways revealed that the XI pathway was best able to metabolize xylose to produce the greatest ethanol yield, while the XR-XDH pathway reached a much faster rate of ethanol production (Karhumaa et al., *Microb Cell Fact.* 6:5 (2007)). See also Int'l Pub. No. WO2006/009434, incorporated herein by reference in its entirety.

In some embodiments, the recombinant microorganisms of the invention have the ability to metabolize xylose using one or more of the above enzymes.

In some embodiments, at least about 10%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, at least about 99%, or 100% of xylo-oligomers in the lignocellulosic material are hydrolyzed to monomeric form during fermentation by the host cell, or any range of values thereof. In some embodiments, at least about 10% to at least about 50%, at least about 20% to at least about 50%, at least about 20% to at least about 60%, at least about 20% to at least about 70%, at least about 20% to at least about 80%, at least about 20% to at least about 90%, or at least about 20% to at least about 99% of xylo-oligomers in the lignocellulosic material are hydrolyzed to monomeric form during fermentation by the host cell.

In some embodiments, the host cell has a specific growth rate ($h^{-1}$) of at least about 0.01, at least about 0.02, at least about 0.03, at least about 0.04, at least about 0.05, at least about 0.06, at least about 0.07, at least about 0.08, at least about 0.09, at least about 0.1, at least about 0.15, at least about 0.2, at least about 0.25, at least about 0.3, at least about 0.35, at least about 0.4, at least about 0.45, at least about 0.5, at least about 0.55, at least about 0.6, at least about 0.65, or at least about 0.7 in a culture medium containing xylose as the primary sugar source, or any range of values thereof. In some embodiments, the host cell has a specific growth rate ($h^{-1}$) of at least about 0.01 to at least about 0.7, at least about 0.05 to at least about 0.7, at least about 0.1 to at least about 0.7, at least about 0.01 to at least about 0.5, at least about 0.05 to at least about 0.5, at least about 0.1 to at least about 0.5, at least about 0.01 to at least about 0.4, at least about 0.05 to at least about 0.4, or at least about 0.1 to at least about 0.4 in a culture medium containing xylose as the primary sugar source.

In some embodiments, a composition of the invention has the ability to metabolize xylose using one or more of the above enzymes.

In some embodiments, the xylose is fermented in about 48 hours or less, about 40 hours or less, about 24 hours or less, or any range of values thereof.

In some embodiments, the xylose in the culture medium is at an initial concentration of at least about 10 g/L, at least about 20 g/L, at least about 30 g/L, at least about 50 g/L, at least about 60 g/L, at least about 70 g/L, or any range of values thereof.

The following embodiments of the invention will now be described in more detail by way of these non-limiting Examples.

EXAMPLES

Example 1

Figure 2:
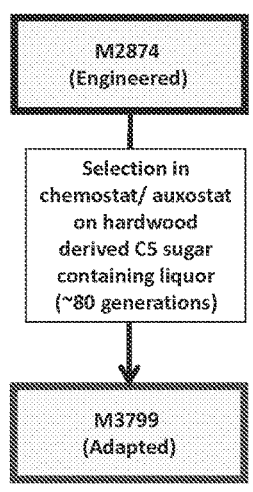
FIG. 2 depicts a time course of adaptation of M2874 to hardwood derived C5 containing liquor. For the first ~400 hours, the reactor was run as a chemostat, with constant feed rate and pH control via $NH_4OH$. Subsequently, a second feed vessel containing C5 liquor was attached and the pH of the culture vessel was maintained by feeding additional C5 liquor (feed pH is higher than pH set point and growing organisms are constantly decreasing the culture vessel pH). Growth rate and percentage of C5 liquor were determined by measuring the mass of feed entering the reactor over time.
Figure 2:
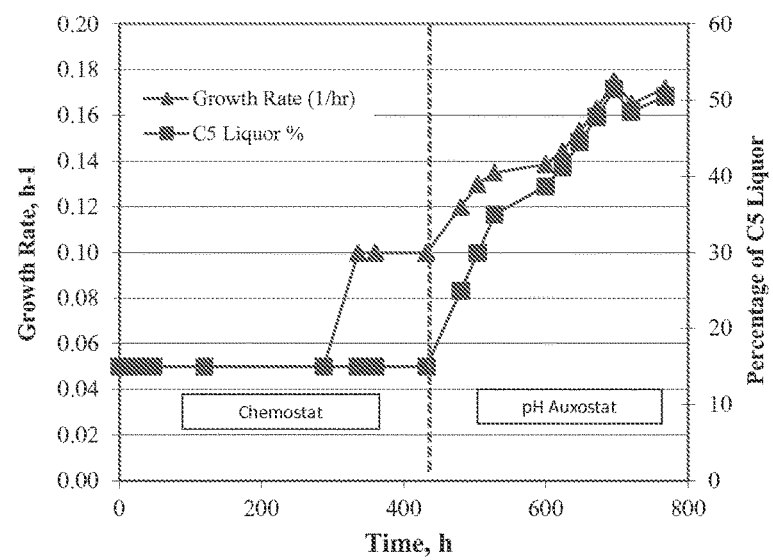

Creation of M3799 and M3059, Robust and Efficient Xylose Utilizing *S. cerevisiae* Strains Strain M2874, which is a xylose utilizing derivative of the robust *S. cerevisiae* strain M2390, described in U.S. Appl. No. 61/557,971, filed Nov. 10, 2011 and Int'l Appl. No. PCT/US2012/064457, filed Nov. 9, 2012, which are incorporated herein by reference, was subjected to adaptation to improve its performance on concentrated C5 containing liquors derived from hardwood. To accomplish this, the strain was subjected to two forms of continuous culture (chemostat and pH auxostat), with results as depicted in FIG. 2.

C5 containing liquor was derived by pretreating hardwood chips at a severity of 3.8, washing the soluble sugars derived in that process out of the solids, hydrolyzing them with 0.5% $H_2SO_4$ in a laboratory autoclave at 121° C. for 3 hours, and adjusting pH to 5.8 using 15M $NH_4OH$. This liquor was diluted to 15% of its original concentration, mixed with medium components (Yeast Nitrogen Base, 6.5 g/L) and fed to a pH controlled bioreactor of constant volume at a constant rate to achieve a dilution rate of 0.05 $hr^{-1}$. After approximately 400 hours of adaptation at this condition, a second feed tank containing liquor at 100% strength and YNB media components, was connected to the bioreactor via the pump typically used to control pH. The pH setpoint was adjusted to 5.2. As the culture grew on the liquor fed from tank 1, the pH was decreased due to the cellular metabolism and the pH control loop was triggered. At this point, additional liquor from feed tank 2 (pH 5.8) was fed to the bioreactor until the pH was restored to the setpoint. This pH auxostat was allowed to run for a further 400 hours, self-adjusting to an ever increasing growth rate achieved by the culture. Single colonies, including one named M3799, were isolated on YPX media and saved at −80° C. from the end of the selection experiment to compare against the parental strain, M2874, and other benchmark strains.

Figure 3:
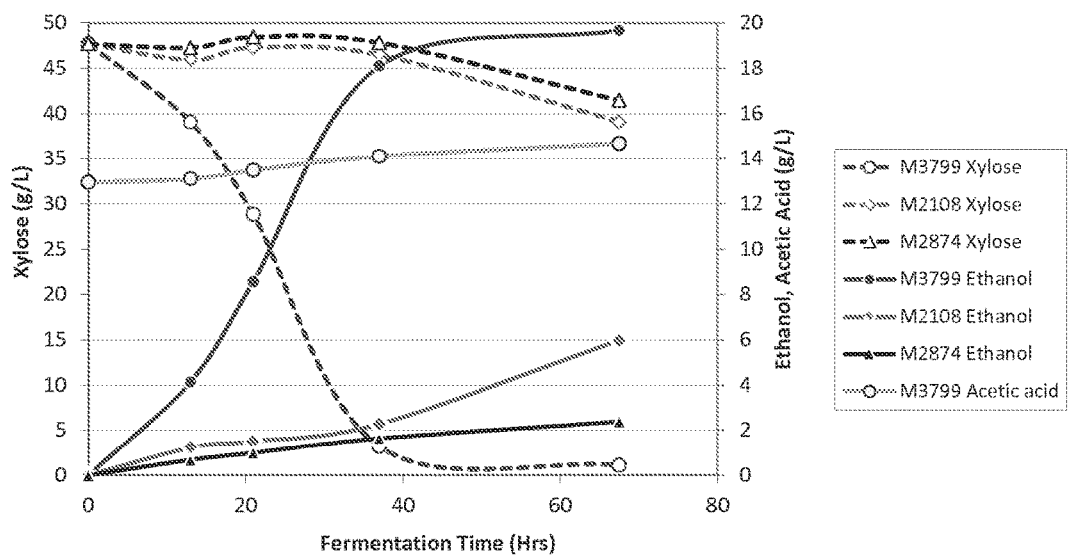
FIG. 3 depicts a comparison of several strains during batch fermentation of C5 liquor, which had been previously hydrolyzed with purified enzymes to yield monomer sugar. Time courses for xylose consumption and ethanol production are shown. The acetic acid concentration for the M3799 fermentation is also shown.

The parental strain M2874, one of the isolated adapted colonies, M3799, and a benchmark strain, and M2108 (described in Int'l Pub. No. WO2011/140386, which is incorporated herein by reference) were compared for their ability to grow on hardwood derived C5 liquors. These comparisons were done by first hydrolyzing the liquor to monomer sugars using a subset of the enzymes described below (FC7, FC36 and FC143), and then loading them at starting concentrations of ~35 g/L and 48 g/L of xylose in small batch fermentations carried out in nitrogen flushed bottles. Strains were inoculated at 0.5 g/L starting concentration and the media components added were 0.5 g/L DAP and 12 g/L CSL. M3799 outperformed the other strains tested in terms of rate of fermentation. Data for the 48 g/L cultures is shown in FIG. 3, and from this data it can be seen that M3799 can complete the fermentation of xylose to ethanol in this toxic environment in approximately 40 hours, while the other strains fermented only a small fraction of the xylose by this timepoint.

Figure 4:
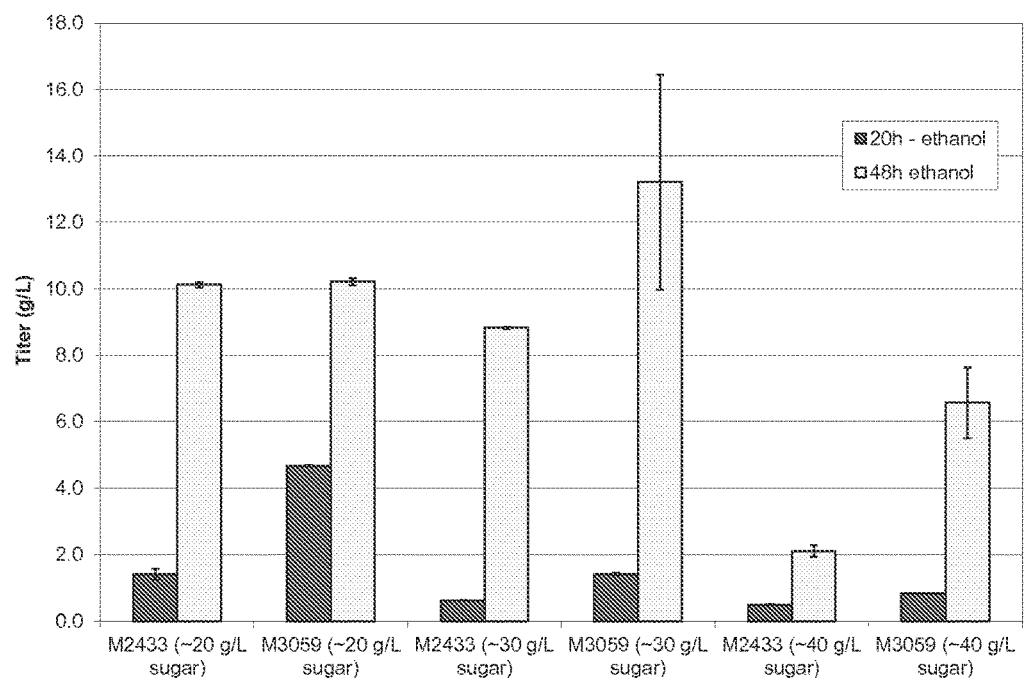
FIG. 4 depicts a comparison of M3059 and parental strain M2433 during batch fermentation of C5 liquor hydrolyzed with acid to yield monomer sugar. Several different concentrations of sugars were used to compare the strains.

Adaptation was also carried out on strain M2433 (described in Int'l Pub. No. WO2011/140386) against hardwood derived C5 oligomers. In this case, a chemostat was run for ~1,000 hours with C5 liquor being fed at a constant rate to a growing culture of M2433. After maintaining this culture for 1,000 hours, colonies were isolated and tested relative to the parental strain M2433. FIG. 4 shows the comparison of the colony isolate, M3059, against M2433 in small batch fermentations at a variety of sugar (and subsequently inhibitor) concentrations. At concentrations of sugar at and above 30 g/L, M3059 is superior in ability to produce ethanol as compared to M2433. These fermentations were inoculated with 0.1 g/L cell dry weight, pH was set with $NH_4OH$ and maintained with calcium carbonate (5 g/L), media was yeast nitrogen base without ammonium sulfate (1.7 g/L), and temperature was maintained at 35° C.

*Saccharomyces cerevisiae* strain M3799, an adapted strain that utilizes xylose and generated by the methods described in Example 1, was deposited with the American Type Culture Collection (ATCC), 10801 University Boulevard, Manassas, Va., 20110 on Aug. 30, 2012, and assigned ATCC Accession No. PTA-13180.

Example 2

Characterizing the Expression and Activity of Auxiliary Cellulases

Figure 5:
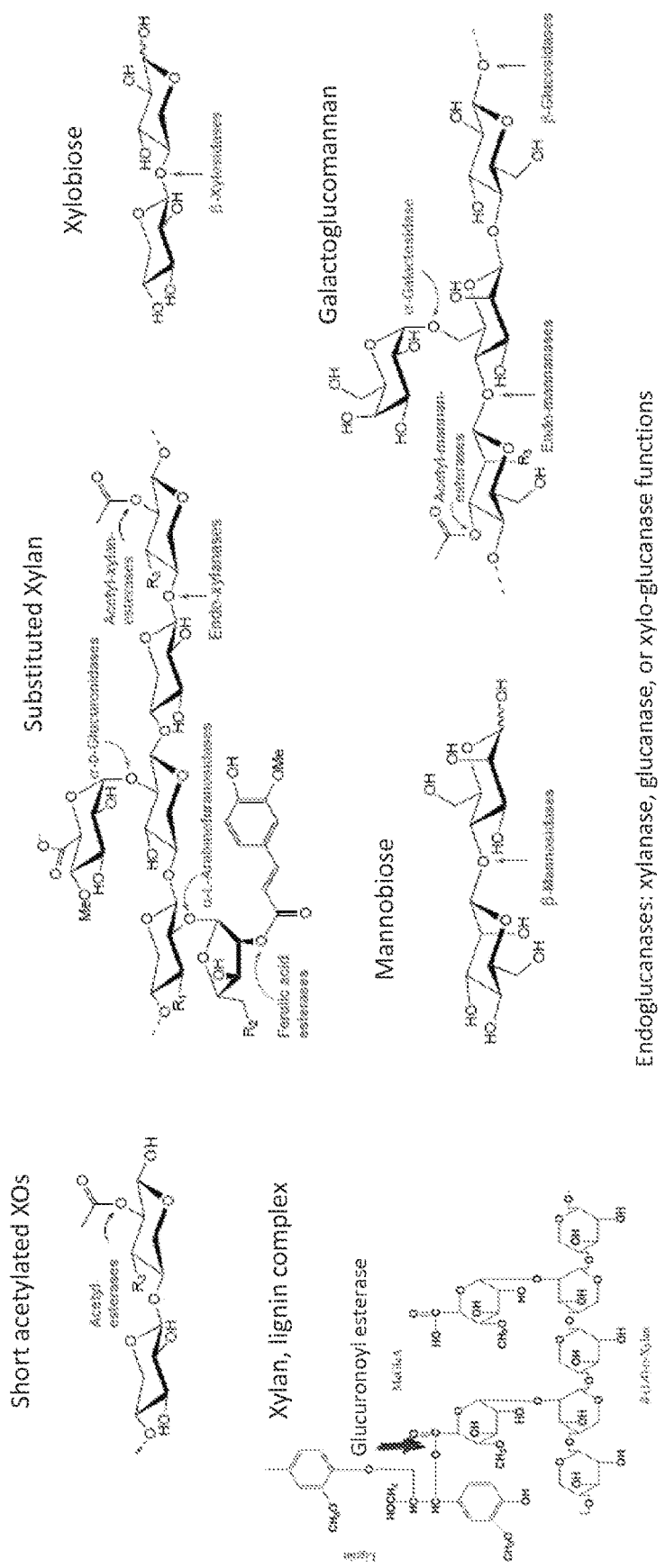
FIG. 5 depicts a schematic of substituted and non-substituted oligomers, and the enzymatic activities required to hydrolyze them, in hardwood derived C5 liquors. "XO" represents xylo-oligomers. This figure is adapted from Shallom, D., & Shoham, Y., Microbial hemicellulases. *Current Opinion in Microbiology,* 6:219-228 (2003); and Spánikova, S., & Biely, P., Glucuronoyl esterase-novel carbohydrate esterase produced by Schizophyllum commune. *FEBS letters,* 580:4597-601 (2006).

The soluble oligomers extracted from hardwood after pretreatment are comprised of a variety of sugars linked in a variety of ways. The linkages require different types of enzymes to hydrolyze them to their component monomer sugars. FIG. 5 presents several of the oligomers hypothesized to be present in hardwood derived soluble oligomers based on examining the literature related to the composition of hardwood (e.g. Wilfor (2005) *Wood Sci Tech*; Teleman (2003) *Carbohydrate Res*; Shallom (2003) *Curr Op Biotech*; Spanikova (2006) *FEBS Letters*; Rowell, R M. Handbook of Wood Chemistry and Composites. London: Taylor & Francis (2005)), as well as the general enzyme types that are expected to hydrolyze these types of bonds.

Figure 6:
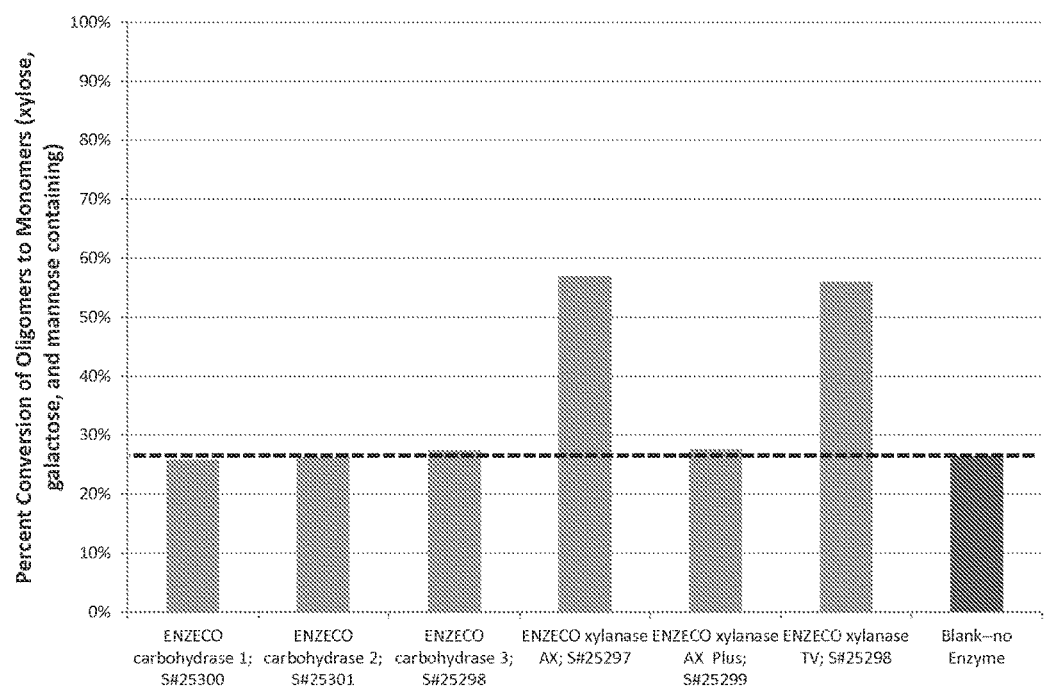
FIG. 6 depicts hydrolysis data for C5 liquor hydrolysis via commercial enzyme preparations. Enzymes were loaded at 10 mg/g xylose (as determined by acid hydrolysis of the starting material) and incubated with C5 liquor and buffer at 50° C., and sugar release was determined by HPLC analysis. Data shown is from 24 hours of hydrolysis, but reaction products did not increase thereafter.

Oligomers of the form extracted, particularly xylo-oligomers, are notable as potent inhibitors of cellulase enzymes during hydrolysis of cellulose (Qing, Q., Yang, B., Wyman, C. E. Xylooligomers are strong inhibitors of cellulose hydrolysis by enzymes. *Bioresource Technol.* 101:9624-9630 (2010)), and hydrolysis of such oligomers using additional enzymes is known to improve conversion of lignocellulosic substrates (Qing, Q., Wyman, C. E. Supplementation with xylanase and β-xylosidase to reduce xylo-oligomer and xylan inhibition of enzymatic hydrolysis of cellulose and pretreated corn stover. Biotechnology for Biofuels, 4:18 (2011)). In addition, commercial enzyme preparations tested are poor at hydrolyzing these oligomers (FIG. 6), in many cases hydrolyzing only a small percentage of the available xylo-oligomers. Therefore, a set of enzymes was developed that could be expressed in *S. cerevisiae* for the purpose of hydrolyzing these materials to near completion.

A set of enzymes, including some previously identified (U.S. Appl. No. 61/420,142 and Intl Pub. No. WO2011/153516), which are incorporated herein by reference) as being functionally expressed in *S. cerevisiae*, and some newly synthesized candidates which were subsequently tested for expression, was developed as a basis for creating a highly efficient enzyme system to hydrolyze oligomeric C5 liquor. The enzymes tested are in Table 4. FC93 through FC137 with a common tag attached to the C-terminus for purification were inserted into the expression vector pMU1531 (described in U.S. Appl. No. 61/420,142 and Int'l Pub. No. WO2011/153516). FC139 and FC142 were tagged, and all three were inserted into *S. cerevisiae* expression vector pMU1531.

TABLE 4

List of enzymes tested for hydrolysis of hardwood derived oligomers.

| Fungal Cellulase (FC)# | Enzyme type | Activity | Organism | Accession # | Strain # | Plasmid # |
|---|---|---|---|---|---|---|
| 7 | CE1 | acetylxylanesterase | *Neosartorya fischeri* | XP_001262186 | M1514 | pMU1934 |
| 15 | CIP2 | glucuronyl esterase | *Trichoderma reesei* | AAP57749 | M1482 | pMU1891 |
| 16 | CIP2 | glucuronyl esterase | *Chaetomium globosum* | XP_001226041 | M1474 | pMU1879 |
| 26 | GH12A | Endoglucanase (EG3) | *Neosartorya fischeri* | XP_001261563 | M1378 | pMU1789 |
| 36 | GH43 | beta-xylosidase, HIS tagged | *Pyrenophora tritici-repentis* | XP_001940956 | M1834 | pMU2173 |
| 37 | GH45A | Endoglucanase (EG5) | *Chrysosporium lucknowense* | ACH15008 | M1395 | pMU1750 |
| 41 | GH5 | Endoglucanase (EG2) | *Hypocrea jecorina* | P07982, AAA34213.1 | M1138 | pMU1400 |
| 56 | GH6 | Endoglucanase (EG6) | *Neurospera crassa* | XP_957415 | M1400 | pMU1755 |
| 61 | GH61A | Endoglucanase (EG4) | *Thielavia terrestris* | ACE10231 | M1418 | pMU1779 |
| 72 | GH7B | Endoglucanase (EG1) | *Aspergillus fumigatus* | XP_747897 | M1311 | pMU1626 |
| 88 | GH5/GH2 | endo-β-mannanase/mannosidase | *Aspergillus aculeatus* | AAA67426 | M1867, M2240 | pMU1903 |
| 93 | GH27 and GH31 | α-galactosidase | *Aspergillus niger* | CAB46229 | M3444 | pMU3150 |
| 94 | GH31 | α-galactosidase | *Talaromyces stipitatus* | XP_002486571 | | pMU3151 |
| 95 | GH27 and GH31 | α-galactosidase | *Aspergillus niger* | CAK43504 | | pMU3217 |
| 96 | GH31 | α-galactosidase | *Metarhizium acridum* CQMa 102 | EFY88353 | | pMU3218 |
| 97 | GH31 | α-galactosidase | *Aspergillus niger* | Q9UUZ4.1 | M3445 | pMU3152 |
| 98 | GH31 | α-galactosidase | *Pyrenophora teres f. teres* 0-1 | XP_003296100.1 | M3446 | pMU3153 |
| 99 | GH27 and GH31 | α-galactosidase | *Talaromyces emersonii* | ABU94728.1 A7XZT2 | M3447 | pMU3154 |
| 100 | GH27 and GH31 | α-galactosidase | *Aspergillus niger* | CAA44950 | | pMU3155 |
| 101 | GH67 | α-glucuronidase | *Chaetomium globosum* | XP_001227924 | | pMU3156 |
| 102 | GH67 | α-glucuronidase | *Neosartorya fischeri* | XP_001259234 | | pMU3157 |
| 103 | GH67 | α-glucuronidase | *Talaromyces emersonii* | AAL33576 | | pMU3219 |

TABLE 4-continued

List of enzymes tested for hydrolysis of hardwood derived oligomers.

| Fungal Cellulase (FC)# | Enzyme type | Activity | Organism | Accession # | Strain # | Plasmid # |
|---|---|---|---|---|---|---|
| 104 | GH67 | α-glucuronidase | Aspergillus fumigatus | XP_753219 | | pMU3158 |
| 105 | GH67 | α-glucuronidase | Pyrenophora tritici-repentis | XP_001933491 | | pMU3159 |
| 106 | GH115 | α-glucuronidase | Aspergillus oryzae | BAE56806 | M3511 | pMU3220 |
| 107 | GH115 | α-glucuronidase | Schizophyllum commune | ADV52250 | M3448 | pMU3160 |
| 108 | GH115 | α-glucuronidase | Neurospora crassa | EAA30769 | | pMU3221 |
| 109 | GH115 | α-glucuronidase | Fusarium sporotrichioides | AAO27748 | | pMU3222 |
| 110 | GH115 | α-glucuronidase | Aspergillus fumigatus | XP_749042 | M3449 | pMU3161 |
| 111 | GH115 | α-glucuronidase | Aspergillus nidulans | EAA66396 | | pMU3162 |
| 112 | GH2 | β-mannosidase | Scheffersomyces stipitis | XP_001386988 | | pMU3163 |
| 113 | GH2 | β-mannosidase | Aspergillus clavatus | XP_001268088 | | pMU3223 |
| 114 | GH2 | β-mannosidase | Debaryomyces hansenii | CAG87955 | M3450 | pMU3164 |
| 115 | GH2 | β-mannosidase | Aspergillus nidulans | ABF50864 | | pMU3165 |
| 116 | GH2 | β-mannosidase | Pyrenophora tritici-repentis | XP_001940689 | | pMU3224 |
| 117 | GH26 | β-mannanase | Humicola insolens | AAQ31840 | M3451 | pMU3166 |
| 118 | GH26 | β-mannanase | Chaetomium globosum | XP_001220544 | M3452 | pMU3167 |
| 119 | GH26 | β-mannanase | Aspergillus niger | XP_001397297 | M3316 | pMU3129 |
| 120 | GH26 | β-mannanase | Chaetomium thermophilum | EGS22650 | M3453 | pMU3168 |
| 121 | GH26 | β-mannanase | Podspora anserina | XP_001904129 | M3454 | pMU3169 |
| 122 | GH5/GH2 | endo-β-mannanase/mannosidase | Aspergillus fumigatus | EAL85463 | M3455 | pMU3170 |
| 123 | GH5/GH2 | endo-β-mannanase/mannosidase | Aspergillus niger | ACJ06979 | M3317 | pMU3130 |
| 124 | GH5/GH2 | endo-β-mannanase/mannosidase | Neosartorya fischeri | XP_001262744 | M3318 | pMU3131 |
| 125 | GH5/GH2 | endo-β-mannanase/mannosidase | Chaetomium globosum | XP_001223421 | M3319 | pMU3132 |
| 126 | GH5/GH2 | endo-β-mannanase/mannosidase | Aspergillus nidulans | Q5B833 | M3320 | pMU3133 |
| 127 | GH113 | β-mannanase | Tetrahymena thermophilum | EAR94190 | M3321 | pMU3134 |
| 128 | GH113 | β-mannanase | Polysphondylium pallidum | EFA85383 | M3322 | pMU3135 |
| 129 | GH113 | β-mannanase | Dictyostelium fasciculatum | EGG23732 | M3323 | pMU3136 |
| 130 | GH1 | β-mannosidase/β-glucosidase | Arabidopsis thaliana | AAM61427 | | pMU3171 |
| 131 | GH1 | β-mannosidase/β-glucosidase | Hordeum vulgare | ACF07998 | | pMU3172 |
| 132 | GH1 | β-mannosidase/β-glucosidase | Oncidium Gower Ramsey | ABC55717 | | pMU3173 |
| 133 | GH1 | β-mannosidase/β-glucosidase | Zea Mays | ACL52625 | | pMU3174 |
| 134 | GH1 | β-mannosidase/β-glucosidase | Oryza sativa | NP_001043156 | | pMU3175 |
| 135 | CE16 | Acetyl esterase | Trichoderma reesei | ABI34466 | M3324 | pMU3137 |
| 136 | CE16 | Acetyl esterase | Aspergillus fumigatus | XP_749200 | M3325 | pMU3138 |
| 137 | CE16 | Acetyl esterase | Chaetomium globosum | XP_001223141 | M3326 | pMU3139 |
| 138 | GH10 | Endo-xylanase | Aspergillus niger | CAA03655.1 | M3441 | pMU2816 |
| 139 | GH31 | α-galactosidase | Trichoderma reesei | Z69253 | M2665 | pMU2981 |
| 140 | GH3 | β-glucosidase | Saccharomycopsis fibuligera | P22506 | | pMU2301 |
| 141 | GH3 | β-glucosidase, HIS tagged | Saccharomycopsis fibuligera | P22506 | M1429 | pMU1172 |
| 142 | GH5/GH2 | β-mannase | Trichoderma reesei | L25310 | M2351 | pMU2659 |
| 143 (SE32) | GH11 | Xylanase | Aspergillus niger | AAS46914.1 | M3136 | pMU2543 |
| 144 (SE66) | CE1 | acetylxylanesterase | Trichoderma reesei | Q99034 | M1782 | pMU2083 |
| 145 | GH67 | α-glucuronidase | Pichia stipitus | XP_001385930 | | pMU2866 |

The plasmids described in Table 4 were transformed into the yeast strain M1744 (described in U.S. Appl. No. 61/420,142 and Int'l Pub. No. WO 2011/153516), and selected on synthetic complete media without uracil (SD-ura) in order to isolate transformants. These transformants were then screened for activity using and appropriate activity assay (see Table 5 and protocols below) to assess if functional protein was being produced. In cases where no activity could be measured, or an assay was not available, western blots were used to assess if protein was being produced. Enzymes that showed the best activity, or the most protein produced as assessed via western blot were subsequently purified and used in hydrolysis assays with C5 liquor. The hydrolysis assay contains diluted C5 liquor, Na-citrate buffered to pH 5.2, purified enzyme and sodium azide to prevent contamination. The resultant sugars were analyzed by BioRad Aminex 87H and 87P HPLC to determine the usefulness of each enzyme. The 87H column can measure acetic acid, but also results in xylose, galactose, and mannose co-eluting, while the 87P column can resolve xylose, galactose, and mannose, but cannot measure acetic acid release. For this reason, both columns were employed to analyze the release of sugars.

The combination of FC7, FC138, FC36 and FC16 (termed as Fav4 below) show good hydrolysis relative to the individual enzymes of the combination of FC36 and FC138, yielding hydrolysis.

TABLE 5

Assays used to test candidates for each activity type.

| Enzyme Type | Assay Used |
| --- | --- |
| Acetylxylanesterase | pNP acetate |
| Glucuronyl esterase | washate assay |
| Endoglucanase (EG3) | CMC |
| β-xylosidase, HIS tagged | pNP-xylobioside |
| Endoglucanase (EG5) | CMC |
| Endoglucanase (EG2) | CMC |
| Endoglucanase (EG6) | CMC |
| Endoglucanase (EG4) | CMC |
| Endoglucanase (EG1) | CMC |
| endo-β-mannanase/mannosidase | AZCL mannan plates and liquid |
| α-galactosidase | pNP galactopyranoside |
| α-glucuronidase | Megazyme kit (Product No: K-AGLUA) |
| β-mannosidase | AZCL mannan plates and liquid |
| β-mannanase | AZCL mannan plates and liquid |
| β-mannosidase/β-glucosidase | AZCL mannan plates and liquid |
| Acetyl esterase | pNP acetate and washate |
| Endo-xylanase | birchwood xylan hydrolysis |
| β-glucosidase, HIS tagged | pNP glucopyranoside, MuCell and cellobiose digestion |

Acid Hydrolysis, Activity Assays, and Western Blot Protocols

Acid Hydrolysis

Acid hydrolysis of oligomers was carried out according to the standard NREL Laboratory Analytical Procedure (LAP) contained in technical report NREL/TP-510-42623.

Assay Protocols for Following Activities

| Activity | Substrate | Manufacturer, Product # |
| --- | --- | --- |
| α-galactosidase | 4-nitrophenyl-α-galactopyranoside | Sigma, N0877 |
| β-mannosidase | 4-nitrophenyl-β-mannopyranoside | Biosynth, N4550 |
| β-mannanase | AZCL-galactomannan | Megazyme, I-AZGMA |
| β-glucosidase | 4-nitrophenyl-β-glucopyranoside | Sigma, N7006 |
| α-arabinofuranosidases | 4-nitrophenyl-α-L-arabinofuranoside | Sigma, N3641 |
| Acetylxylanesterases | 4-nitrophenyl acetate | Sigma, N8130 |

Procedures
1. Make up Solutions
   a. 200 mM 4np-galactopyranoside in DMSO
   b. 200 mM 4np-mannopyranoside in DMSO
   c. 1% AZCL-galactomannan in 50 mM Na Acetate buffer, pH5
   d. 200 mM 4np-glucopyranoside in DMSO
   e. 200 mM 4np-α-L-arabinofuranoside in DMSO
   f. 200 mM 4-np-acetate in DMSO
2. Pellet cells grown in 48 well plate by centrifugation.
3. Dilute the substrates with a 4-nitrophenyl group from above to 2 mM in 50 mM Na Ac pH5, except for those in 1e and 1f, dilute these to 1 mM in 50 mM citrate buffer pH 5.0
4. Set up and run assays in a clear bottom 96 well plate as follows:

α-galactosidase
Add: 50 ul 2 mM 4np-α-galactopyranoside
Add: 50 ul supernatant from cells
Incubate: 35 C for 1 h
Stop reaction: 50 ul 1M NaHCO3
Read in 96 well plate reader @ 405 nm β-mannosidase
Add: 50 ul 4np-β-mannopyranoside
Add: 50 ul supernatant from cells
Incubate: 35 C for 1 h
Stop reaction: 50 ul 1M NaHCO3
Read in 96 well plate reader @ 405 nm β-mannanase
Add: 100 ul 1% AZCL-galactomannan
Add: 100 ul supernatant from cells
Incubate: 35 C, mixing at 900 rpm for 1 h
Dilute: with 100 ul 50 mM Na Ac pH5
Mix: 2000 rpm×2 min
Transfer: 50 ul to clear bottom plate
Read in 96 well plate reader @ 590 nm β-glucosidase
Add: 50 ul 4np-β-glucopyranoside
Add: 50 ul supernatant from cells
Incubate: 35 C for 1 h
Stop reaction: 50 ul 1M NaHCO3
Read in 96 well plate reader @ 405 nm α-arabinofuranosidases
Add: 100 ul 4np-α-L-arabinofuranoside solution
Add: 50 ul supernatant from cells
Incubate: 35 C for 2 h
Add: 10 uL of 1M Tris HCL buffer, pH 7.5
Read in 96 well plate reader @ 410 nm Acetylxylanesterases
Add: 100 ul 4np-acetate solution
Add: 50 ul supernatant from cells
Incubate: 35 C for 2 h
Add: 10 uL of 1M Tris HCL buffer, pH 7.5
Read in 96 well plate reader @ 410 nm Carboxymethylcellulose (CMC) Conversion Assay Procedure
1. Inoculate strains to be tested in 10 mL YPD (or other media) in 50 ml tubes and grow with shaking for 3 days.
2. Prepare the 1.14% CMC substrate, 1.14 g CMC per 100 mL citrate buffer (50 mM pH 5.5) autoclaved for 20-25 min. Agitate to make sure all CMC is dissolved.
3. To 44 mL of 1.14% CMC add 1 mL of 0.5% of sodium azide.
4. Spin cells in 50 ml tubes at max speed for 10 min 5. Add CMC and azide mixture from step 3 to deep well 96-well plate, 450 μL/well.
6. Do 4 replicates for each strain.
7. Aliquot 100 μL of DNS into 96-well PCR plate
8. Add 50 μL of yeast supernatant or 50 mM citrate buffer pH 5.5 to the substrate and mix by pipetting
9. Take T=0 sample (time=0): transfer 50 μL of the reaction mixture from step 8 to the 96-well PCR plate containing DNS and mix
10. Put the deep well plate at 35° C. 800 rpm
11. Heat the PCR plate at 99° C. for 5 min and cool down to 4° C. in PCR machine
12. Transfer 50 μL from the PCR plate to a microtiter plate.
13. Measure absorbance at 565 nm 4. Distribute 50 ul of substrate into each well of a microtiter 96 well plate
5. add 50 ul of diluted yeast supernatants to each well
6. incubate at 37° C. for 15 min
7. add 100 μl of 1 M $Na_2CO_3$ to each well to stop the reaction
8. read the fluorescence in microtiter plate reader (ex. 355 nm and em. 460 nm)

Determination of Xylanase Activity (Bailey M. J., Biely P., Poutanen K., Interlaboratory Testing of methods for assay of xylanase activity. *J Biotechnol* 23:257-270 (1992)).

1. Centrifuge a small sample of cell culture at >5K for 2 min, or enough to pellet cells, and use supernatant for assays.
2. Prepare and treat xylanase assay reaction mixtures as follows:

TABLE 6

| Step | Xylanase assay | (amt) | Enzyme blank | (amt) | Reagent blank | (amt) |
|---|---|---|---|---|---|---|
| 1 | Substrate | 450 ul | Substrate | 450 ul | Substrate | 450 ul |
| 2 | Temperate to 50° C. | | None | | None | |
| 3 | Enzyme* (mix) | 50 ul | Incubate at 50° C. for 5 min | | Incubate at 50° C. for 5 min | |
| 4 | Incubate at 50° C. for 5 min | | Add DNS | 750 ul | Add DNS | 750 ul |
| 5 | Add DNS | 750 ul | Add Enzyme* | 50 ul | Add Buffer | 50 ul |
| 6 | Mix | | Mix | | Mix | |
| 7 | Boil for 15 min. | | Boil for 15 min. | | Boil for 15 min. | |
| 8 | Cool in cold water. | | Cool in cold water. | | Cool in cold water. | |
| 9 | Measure color at 540 nm | | Measure color at 540 nm. | | Measure color at 540 nm. | |
| 10 | | | | | Zero spec. | |

*Diluted appropriately with citrate buffer.

14. Take samples from reaction plate after 24 hours and repeat steps 6-12
15. Calculate % of CMC converted at time 24 hrs using formula:

The percentage of the CMC converted at time 24 hrs. can be calculated using formula:

$$Y = \frac{(OD(T=24) - OD(T=0)) \times 100\%}{S \times A}$$
$$= \frac{\Delta OD \times 100}{-0.1 \times 10}$$
$$= \Delta OD \times 100$$

Y—% of CMC converted at 24
S—DNS/glucose calibration slope (approximately 0.1)A—CMC concentration at T=0 that is 10 g/L for 1% CMC
Reagents:
Dinitrosalicylic Acid Reagent Solution (DNS), 1% (Could be stored at 4° C. for several months)
3,5-dinitrosalicylic acid: 10 g
Sodium sulfite: 0.5 g
Sodium hydroxide: 10 g
Add water to: 1 liter
Calibrate DNS by glucose (use glucose samples with conc. 0, 1, 2, 3, 4, 5, 6, 7, 8, 9, 10 g/l, calculate the slope [S])
MU-Cellobioside Assay
1. Grow cells in 600 ul YPD in 96 well plates at 35° C. overnight
2. Dilute cell supernatants 3-9 times in the 50 mM Citrate Buffer buffer pH 5.5
3. Make 4 mM Mu-Cellobioside in the 50 mM Citrate Buffer pH 5.5 (0.01 g/5 ml per 96 wp)

Preparation of Solutions

TABLE 7

| DNS Solution | |
|---|---|
| DNS solution (Miller G. L.. Use of dinitrosalicylic acid reagent for determination of reducing sugar. *Anal. Chem.* 31: 426-428 (1959).) | Amount |
| 2-Hydroxy-3,5-dinitrobenzoate | 10.0 g |
| Potassium-sodium-tartrate | 200.0 g |
| NaOH | 10.0 g |
| Phenol | 2.0 g |
| Na-sulfite | 0.5 g |
| $dH_2O$ (make up to) | 1000.0 ml |

TABLE 8

| Citrate Buffer | |
|---|---|
| Citrate Buffer (0.05M pH 5) | 1 L |
| 0.1M Citric acid: | 21.01 g citric acid in 1000 ml H2O |
| 0.1M Sodium citrate: | 29.41 g of $C_6H_5O_7Na_3 \cdot 2H_2O$ in 1000 ml $H_2O$ |
| Combine: 20.5 ml of citric acid + 29.5 ml of sodium citrate, add $dH_2O$ to a total of 100 ml, adjust pH with NaOH, or HCL as necessary. | |

TABLE 9

Substrate solution
Substrate solution 1.0% Birchwood 4-O-methyl glucuronoxylan (Sigma) in 0.05M Na-citrate buffer, pH 5. 1.0 g was homogenized in 80 ml buffer at 60° C. and heated to its boiling point using a magnetic stirrer. The solution was cooled with continued stirring and covered and stirred slowly overnight. The solution was brought up to 100 ml with buffer, and can be stored at 4° C. for a maximum of 1 week or frozen in aliquots of e.g. 25 ml at −20° C. The solution should be mixed well after thawing.

TABLE 10

Xylose standard
Xylose standard

The standard is pure xylose, stock solution 0.01M (0.15 g per 100 ml buffer). Stock solution can be stored in aliquots at −20° C.

TABLE 11

Multiple Timepoints 96 Well format for Xylanase Assay.

| Substrate | 450 µl (1% 4-O-methyl glucuronoxylan substrate solution described above) |
|---|---|
| The substrate was incubated for 5 min at 45° C. Enzyme containing the culture supernatant was added | 50 µl |
| The solution was incubated at 35° C. Samples were removed at 0 h, 2.5 h and 24 h - PCR plate. | 25 µl |
| DNS was added | 50 µl |
| Xylose standard (reagent blank with citrate buffer) | 10 µl (to standard wells or citrate to blank wells) |
| The samples were heated to 99° C. for 15 min The plate was cooled in and ice bucket. 100 µl was transferred. to 96 well round bottom plate $OD_{540}$ was measured in a plate reader. | |

Western Blot Protocol for Supernatants of Strains:
1. Take top performing strains for activity, along with randomly selected α-glucuronidase strains (no activity assay available) and run on a 4-20% Tris glycine SDS-PAGE gel (Invitrogen, EC6025BOX), transfer to PVDF membrane (Amersham Hybond P, GE Healthcare, RPN303F) and block overnight in TBS (10 mM Tris, 150 mM NaCl, pH 7.5)+2% BSA (bovine serum albumin)
2. Dilute primary Qiagen muα Penta-His 1:5000 in TBST (TBS with 0.1% Tween 20). Pour off blocker and add primary antibody. Incubate at room temperature for 1 h.
3. Pour off primary antibody and wash 3×5 min in THST (10 mM Tris, 500 mM NaCl, pH 7.5 with 0.1% Tween 20).
4. Dilute Thermo gtαmu-HRP (cat. No. 31439) 1:7500 in TBST and add to blots. Incubate at room temperature for 1 h, pour off and wash again with THST
5. Add ECL (Thermo, 32166) substrate and visualize using a Syngene G:BOX with a CCD camera.

Figure 7:
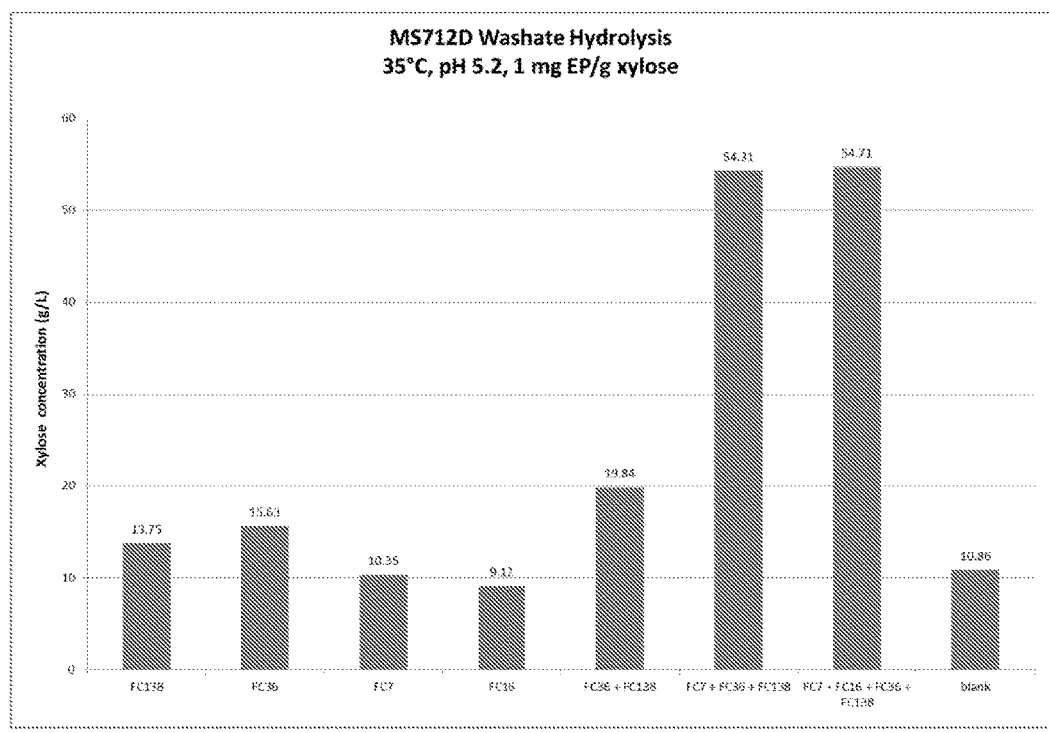
FIG. 7 depicts individual yeast produced and purified components tested individually and in combination for the hydrolysis of hardwood derived C5 liquor. In this assay, liquor MS712D was loaded at approximately 75 g/L total xylose concentration (determined by acid hydrolysis of the starting material). The enzymes were loaded at a constant total enzyme loading of 1 mg enzyme protein (EP) per gram of total xylose.

FIG. 7 depicts the hydrolysis of hardwood derived C5 liquor by individual yeast produced purified enzymes as well combinations, including an acetylxylanesterase, a beta-xylosidase, an endo-xylanase, and a glucuronyl esterase. This test shows that individual enzymes and combinations of two enzymes do not produce significant oligomer hydrolysis (i.e., <15% of the starting oligomers were hydrolyzed by these single enzymes and combinations. In contrast, the combination of FC7, FC138, FC36, and FC16 (termed as Fav4 below) show good hydrolysis, achieving >80% hydrolysis of the substituted xylo-oligomers present.

Figure 8:
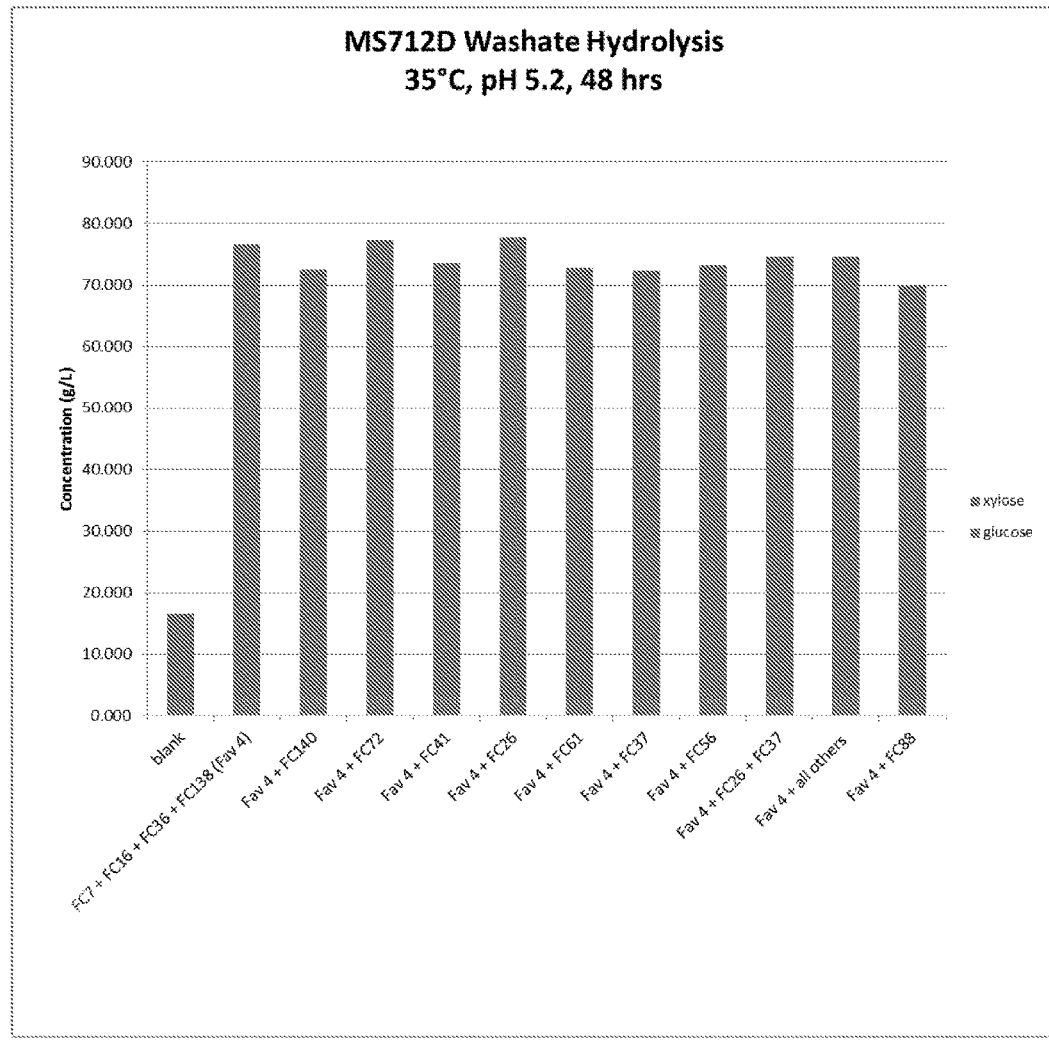
FIG. 8 depicts individual yeast produced and purified components tested in combination with "Fav4" (FC7, FC16, FC138 and FC36) for the hydrolysis of hardwood derived C5 liquor. In this assay, liquor MS712D was loaded at approximately 75 g/L total xylose concentration as determined by acid hydrolysis of the starting material.
Figure 9:
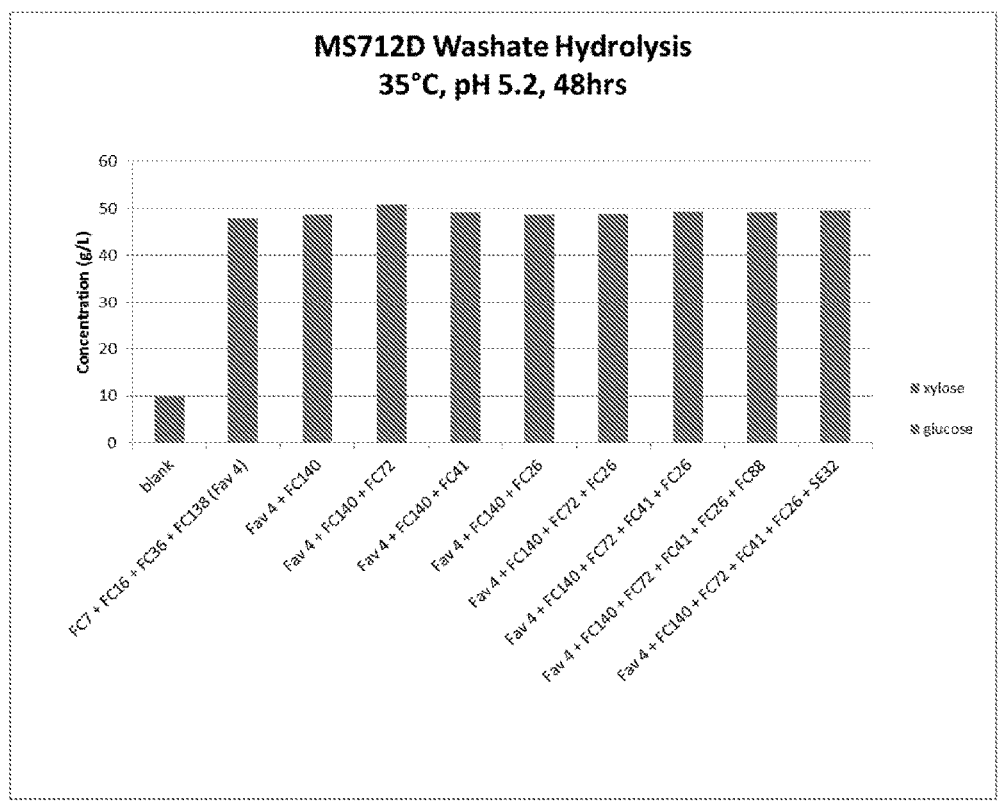
FIG. 9 depicts yeast produced and purified components tested in combination with Fav4 and FC140 for the hydrolysis of hardwood derived C5 liquor. In this assay, liquor MS712D was loaded at approximately 50 g/L total xylose concentration as determined by acid hydrolysis of the starting material.
Figure 10:
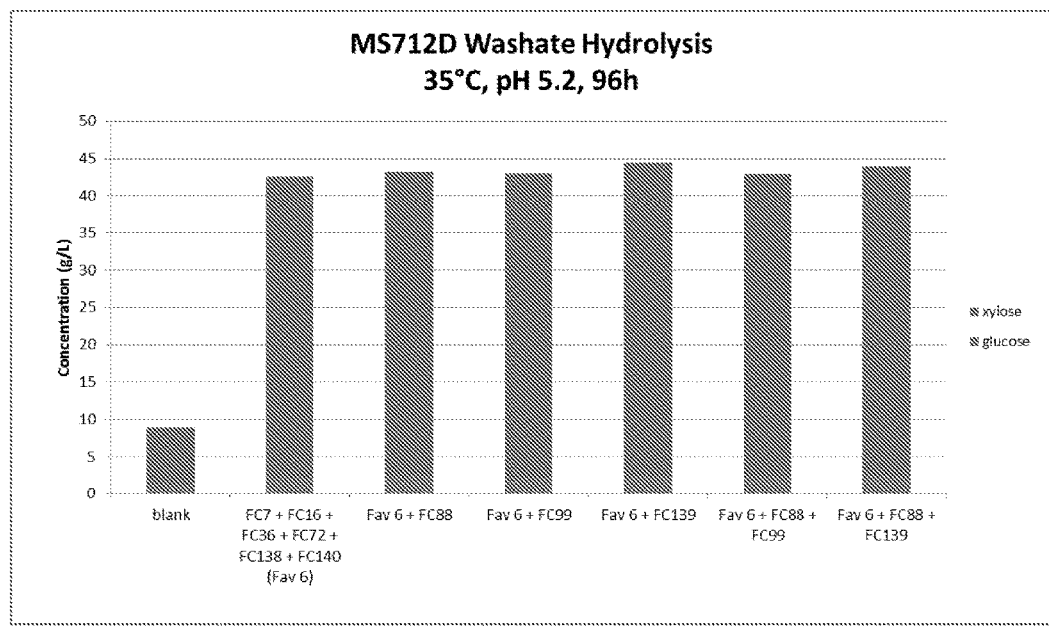
FIG. 10 depicts yeast produced and purified components tested in combination with "Fav6" (FC7, FC138, FC36, FC16, FC140 and FC72) for the hydrolysis of hardwood derived C5 liquor. In this assay, liquor MS712D was loaded at approximately 50 g/L total xylose concentration as determined by acid hydrolysis of the starting material.
Figure 11:
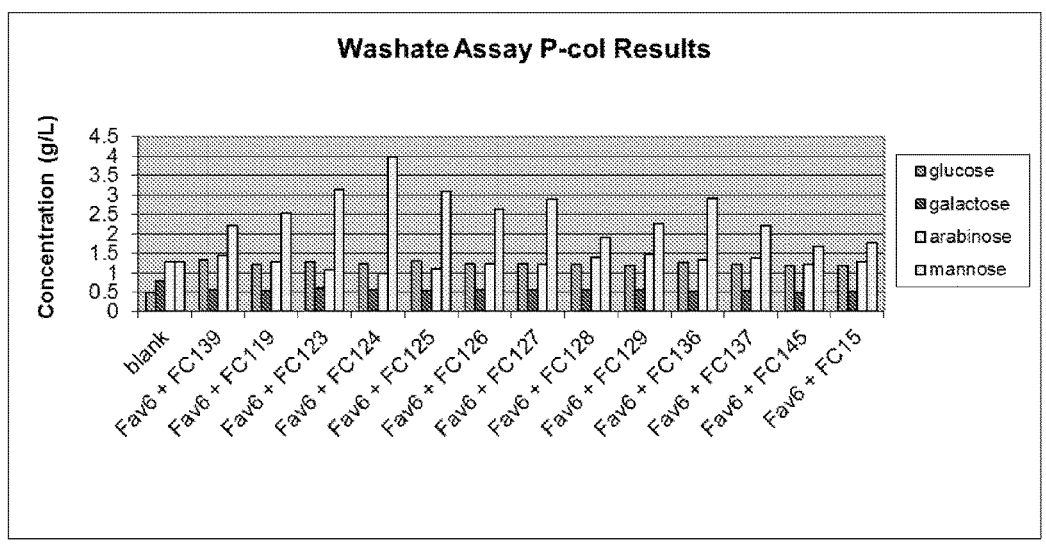
FIG. 11 depicts yeast produced and purified components tested in combination with Fav6 for the hydrolysis of hardwood derived C5 liquor. In this assay, liquor MS712D was loaded at approximately 50 g/L total xylose concentration as determined by acid hydrolysis of the starting material. The data was generated using the BioRad Aminex 87P HPLC column to determine the amount of minor component sugars released relative to control (blank).
Figure 12:
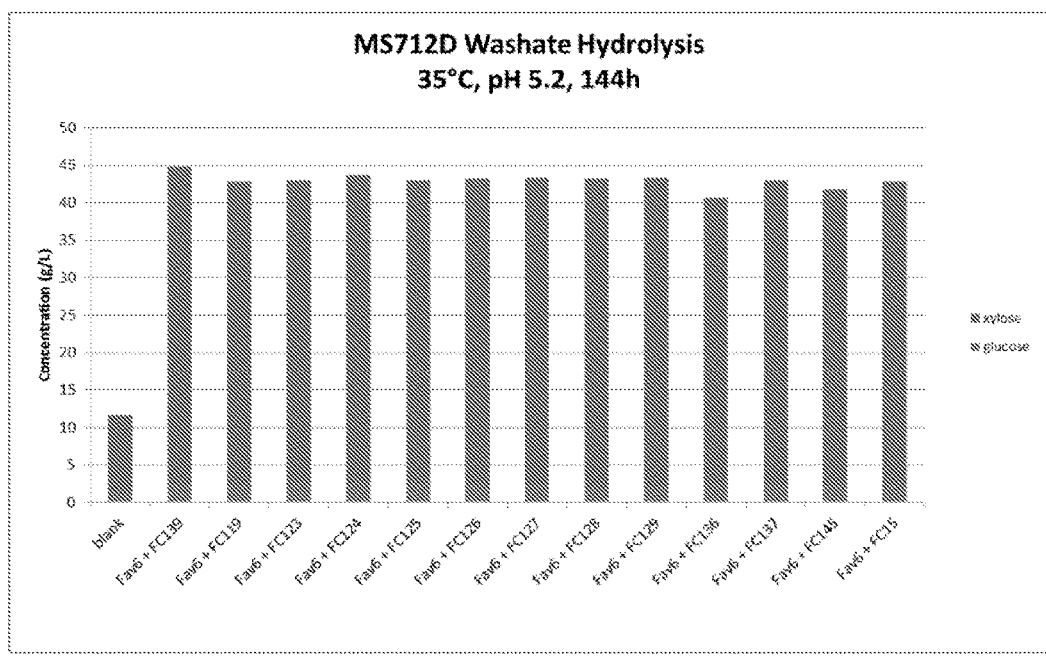
FIG. 12 depicts yeast produced and purified components tested in combination with Fav6 for the hydrolysis of hardwood derived C5 liquor. In this assay, liquor MS712D was loaded at approximately 50 g/L total xylose concentration as determined by acid hydrolysis of the starting material. The data was generated using the BioRad Aminex 87H HPLC column to determine the amount of major component sugars released relative to control (blank).
Figure 13:
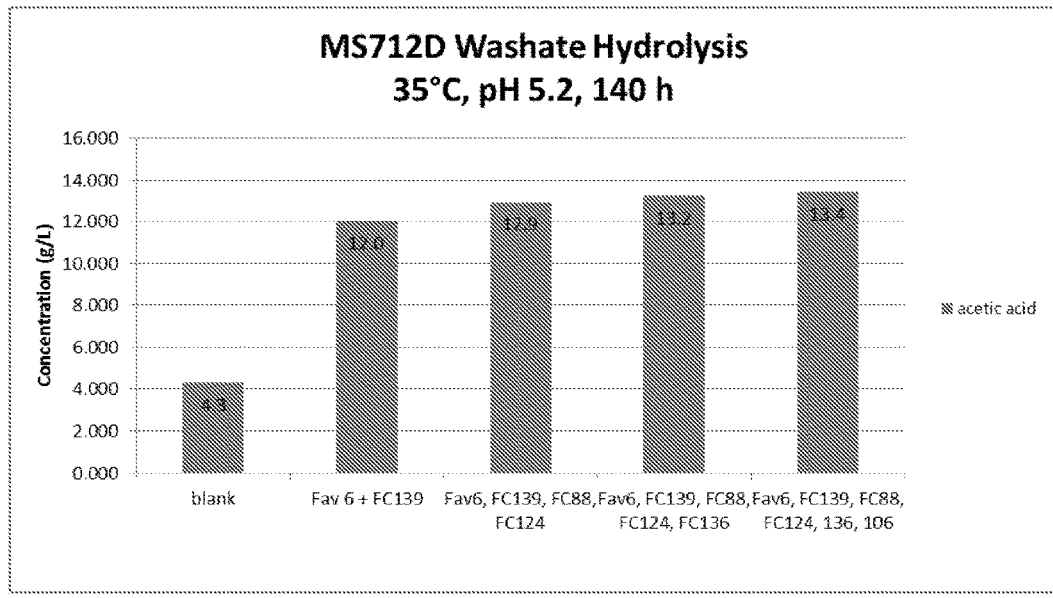
FIG. 13 depicts yeast produced and purified components tested in combination with Fav6 for the release of acetate from hardwood derived C5 liquor. In this assay, liquor MS712D was loaded at approximately 50 g/L total xylose concentration as determined by acid hydrolysis of the starting material. The data was generated using the BioRad Aminex 87H HPLC column.

FIG. 8 depicts attempts to increase hydrolysis by testing several endoglucanase types as well as β-glucosidase. Increases in glucose release are evident when β-glucosidase (FC140), EG1 (FC72), and EG3 (FC26) were added to the reaction. In FIG. 9, when both FC140 and FC72 were added to the Fav4 together, the best performance was realized. This combination of FC7, FC138, FC36, FC16, FC140, and FC72 was termed the "Fav6." FIG. 10 shows the result of adding several additional enzymes to the Fav6. The best hydrolysis occurred when a functional α-galactosidase was added (FC139). FIGS. 11 and 12 give the results for additional screening of enzymes in conjunction with the Fav6. FIG. 11 shows the release of minor component sugars from data generated using the BioRad Aminex 87p HPLC column. From these data, it is clear that while several of the added enzymes release additional mannose, the endo-β-mannanase/mannosidase from N. fischeri (FC124) resulted in the highest release of mannose. FIG. 12 confirms that the addition of FC139 results in the highest total xylose and glucose release as determined by the BioRad Aminex 87H HPLC column. FIG. 13 depicts the effect of the combination of the enzymes with respect to acetic acid release from C5 oligomers, which gives an idea of which enzymes are important for releasing more of this important substituent from the xylan backbone. With the increasing number of enzymes previously shown to be beneficial added, more acetic acid was released. In addition, an α-glucuronidase enzyme (FC106) was shown to improve the removal of acetyl groups from the backbone.

Figure 14:
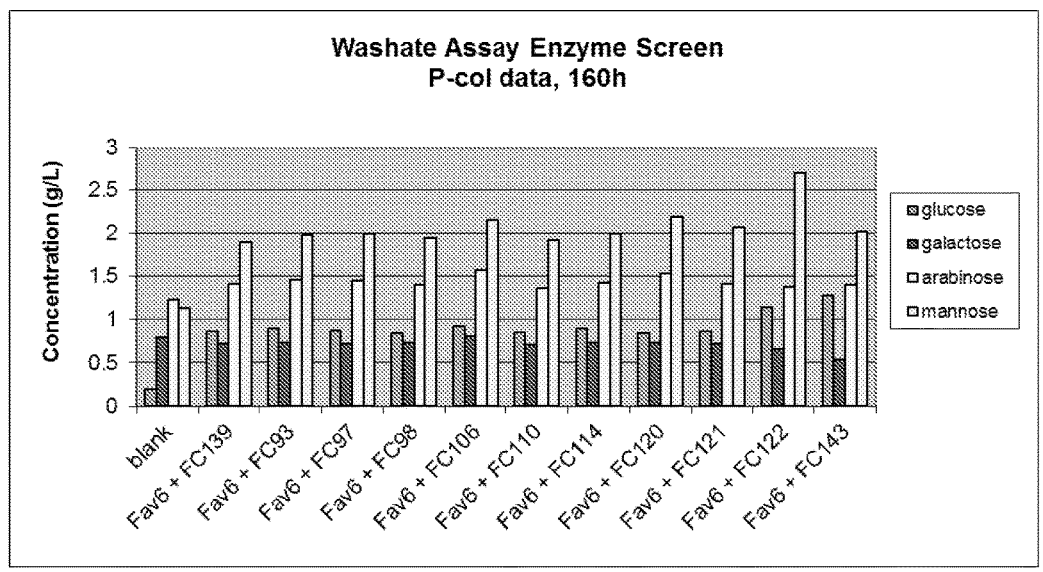
FIG. 14 depicts yeast produced and purified components tested in combination with Fav6 for the release of minor component sugars from hardwood derived C5 liquor. In this assay, liquor MS712D was loaded at approximately 50 g/L total xylose concentration as determined by acid hydrolysis of the starting material. The data was generated using the BioRad Aminex 87P HPLC column.
Figure 15:
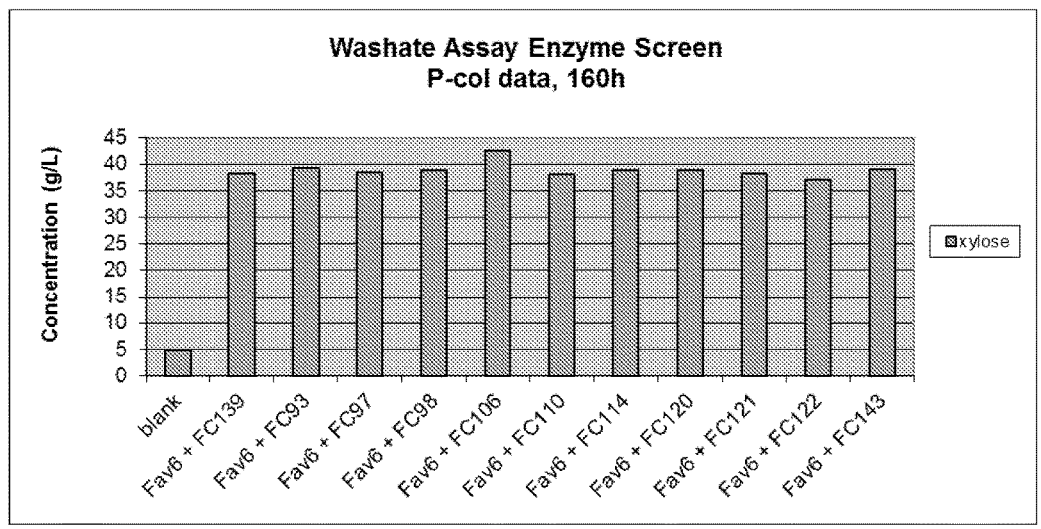
FIG. 15 depicts yeast produced and purified components tested in combination with Fav6 for the release of xylose from hardwood derived C5 liquor. In this assay, liquor MS712D was loaded at approximately 50 g/L total xylose concentration as determined by acid hydrolysis of the starting material. The data was generated using the BioRad Aminex 87P HPLC column.
Figure 16:
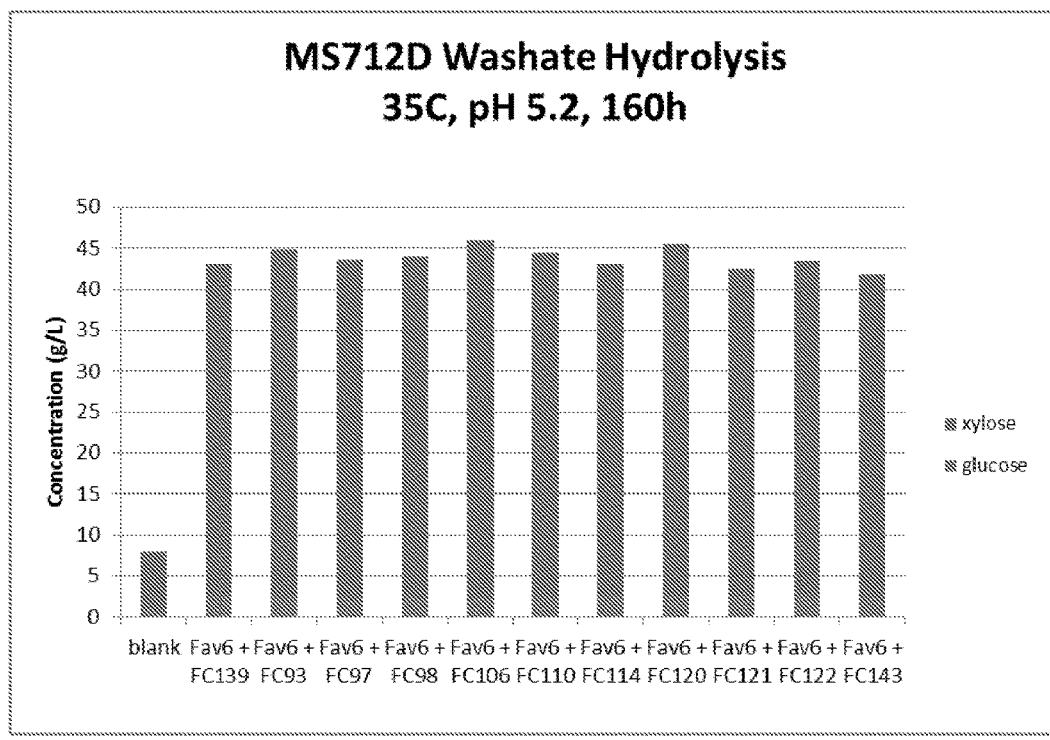
FIG. 16 depicts yeast produced and purified components tested in combination with Fav6 for the release of monomer sugars from hardwood derived C5 liquor. In this assay, liquor MS712D was loaded at approximately 50 g/L total xylose concentration as determined by acid hydrolysis of the starting material. The data was generated using the BioRad Aminex 87H HPLC column.

FIGS. 14-16 depict data from a subsequent screen where a different set of purified enzymes was tested in conjunction with the Fav6. FIG. 14 shows the release of minor component sugars (as measured on the 87P column). FIG. 15 shows the release of xylose (as measured on the 87P column). FIG. 16 shows the release of xylose and glucose on the 87H column capturing all the components. From these data, it appears that FC122, an endo-β-mannanase/mannosidase, releases significant mannose, but not as much as FC124, while FC106, an β-glucuronidase appears to be important for the release of xylose, as well as the release of total sugars.

From the data combined generated during screening, it was determined that the following enzymes was useful for hydrolyzing C5 liquors: FC7, FC138, FC36, FC16, FC140, FC72, FC88, FC139, FC124, and FC106.

Figure 17:
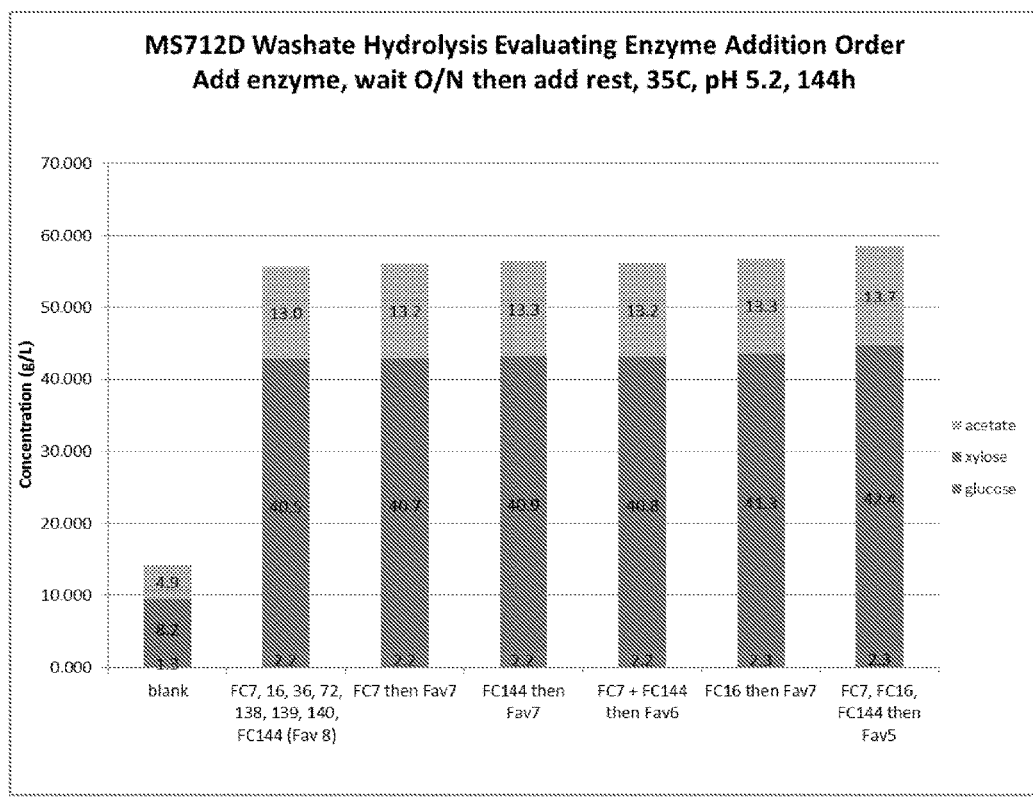
FIG. 17 depicts yeast produced and purified components tested in combination for the release of monomer sugars from hardwood derived C5 liquor. In the cases with a "then" in the label, one or more enzymes from the "Fav8" group (FC7, FC16, FC36, FC72, FC138, FC139, FC140 and FC144) were added first and allowed to incubate for ~16 hours before the rest of the enzyme(s) were added, and allowed to incubate. In this assay, liquor MS712D was loaded at approximately 50 g/L total xylose concentration as determined by acid hydrolysis of the starting material. The data was generated using the BioRad Aminex 87H HPLC column.
Figure 18:
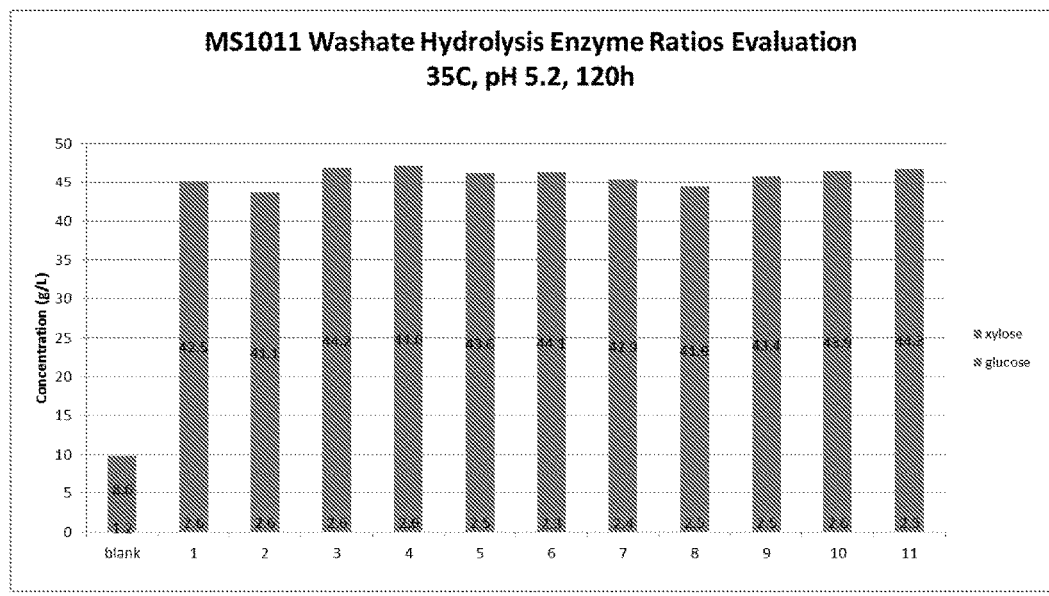
FIG. 18 depicts yeast produced and purified components tested in different ratios for the release of monomer sugars from hardwood derived C5 liquor. In this assay, liquor MS1011 was loaded at approximately 50 g/L total xylose concentration as determined by acid hydrolysis of the starting material. The data was generated using the BioRad Aminex 87H HPLC column.
Figure 19:
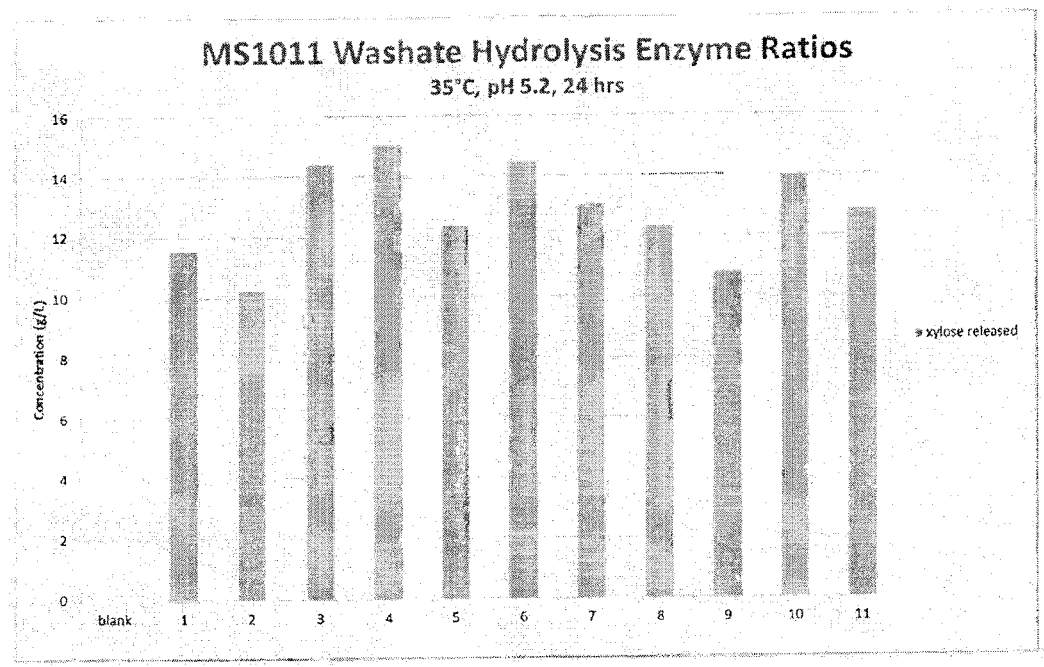
FIG. 19 depicts data from 24 hours of hydrolysis by ratios of enzymes for which 120 hour data is shown in FIG. 18.
Figure 20:
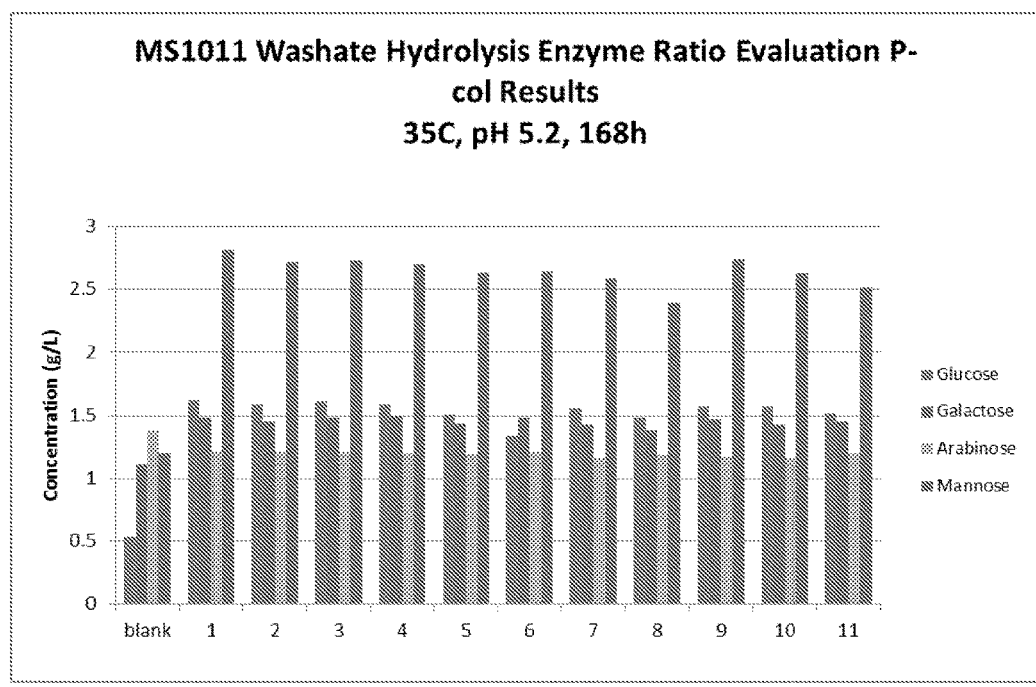
FIG. 20 depicts data from the same assay carried out in FIG. 18, but the data shown was generated using the BioRad Aminex 87P HPLC column to examine the minor sugar components.

Several additional experiments were carried out to determine if the ratio of enzymes loaded into the reaction, or the order of enzymes loaded into the reaction was important. FIG. 17 demonstrates that the addition of single and combinations of esterases targeting the removal of acidic groups prior to the addition of the other enzymes for hydrolysis of the oligomers can lead to a slightly increased overall hydrolysis yield. With respect to the testing of ratios shown in FIG. 18, the largest effect on yield appeared to be from enriching FC36, the β-xylosidase. Data from this experiment is also shown in FIG. 19 for the release of xylose in the first 24 hours of hydrolysis. These data show that enriching for FC36 results in the fastest release of xylose in the reaction, with an increase of 50% in the rate when the amount of FC36 is raised from 10% of the total enzyme loaded to 30%. Testing from this point on used a higher proportion of FC36 in the mix of enzymes. FIG. 20 depicts data from the same assay carried out in FIG. 18, but the data shown was generated using the BioRad Aminex 87P HPLC column to examine the minor sugar components.

TABLE 12

Amounts of enzymes used in testing various ratios of enzymes targeting the hydrolysis of C5 liquors. For each mix (1 to 11), the total amount of enzyme loaded is 2 mg of enzyme per gram of xylose loaded into the hydrolysis assay as measured by acid hydrolysis of the starting material.

| | mg EP/g xylose | | | | | | | | to-tal |
|---|---|---|---|---|---|---|---|---|---|
| | FC138 | FC36 | FC7 | FC16 | FC140 | FC72 | C139 | FC142 | |
| 1 | 0.25 | 0.25 | 0.25 | 0.25 | 0.25 | 0.25 | 0.25 | 0.25 | 2 |
| 2 | 0.60 | 0.20 | 0.20 | 0.20 | 0.20 | 0.20 | 0.20 | 0.20 | 2 |
| 3 | 0.40 | 0.40 | 0.20 | 0.20 | 0.20 | 0.20 | 0.20 | 0.20 | 2 |
| 4 | 0.20 | 0.60 | 0.20 | 0.20 | 0.20 | 0.20 | 0.20 | 0.20 | 2 |
| 5 | 0.50 | 0.40 | 0.20 | 0.10 | 0.10 | 0.30 | 0.20 | 0.20 | 2 |
| 6 | 0.40 | 0.40 | 0.30 | 0.10 | 0.10 | 0.30 | 0.20 | 0.20 | 2 |
| 7 | 0.40 | 0.40 | 0.20 | 0.10 | 0.10 | 0.10 | 0.30 | 0.40 | 2 |
| 8 | 0.40 | 0.40 | 0.10 | 0.10 | 0.10 | 0.10 | 0.40 | 0.40 | 2 |
| 9 | 0.40 | 0.40 | 0.40 | 0.10 | 0.10 | 0.20 | 0.20 | 0.20 | 2 |
| 10 | 0.40 | 0.40 | 0.20 | 0.10 | 0.10 | 0.40 | 0.10 | 0.30 | 2 |
| 11 | 0.40 | 0.40 | 0.20 | 0.10 | 0.10 | 0.40 | 0.30 | 0.10 | 2 |

Figure 21:
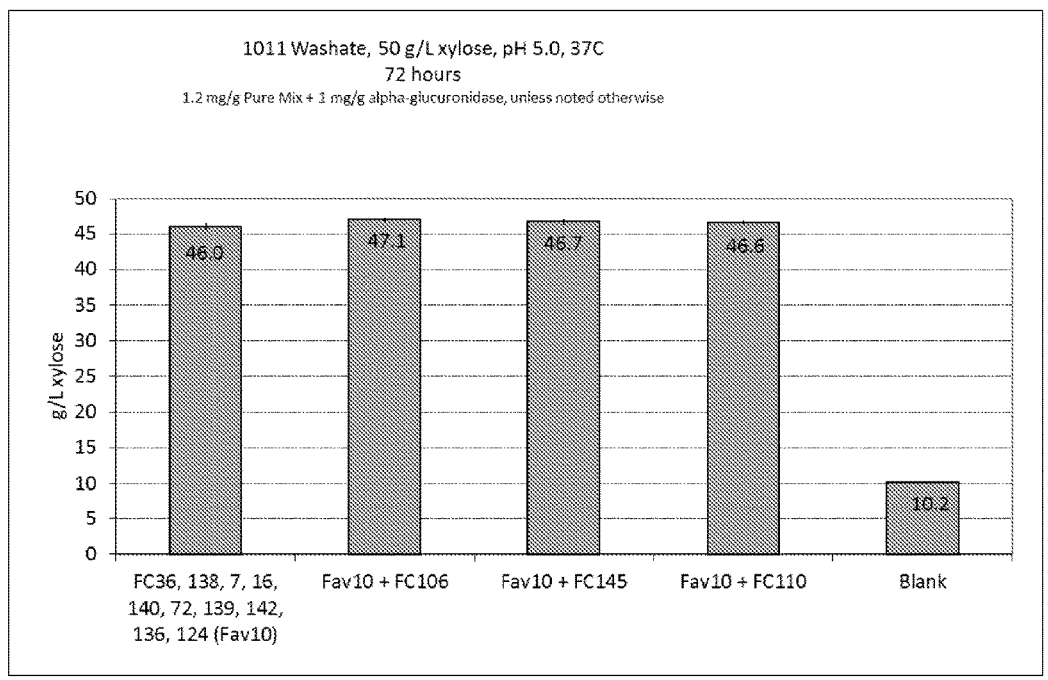
FIG. 21 depicts yeast produced and purified α-glucuronidase components (loaded at 1 mg/g) tested in combination with the "Fav10" group (FC36, FC138, FC7, FC16, FC140, FC72, FC139, FC142, FC136 and FC124; loaded at 1.2 mg/g) for the release of monomer sugars from hardwood derived C5 liquor. In this assay, liquor MS1011 (1011) was loaded at approximately 50 g/L total xylose concentration as determined by acid hydrolysis of the starting material. The data was generated using the BioRad Aminex 87H HPLC column.

FIG. 21 presents data generated to test the utility of different α-glucuronidases, FC106, FC145, and FC110.

Figure 22:
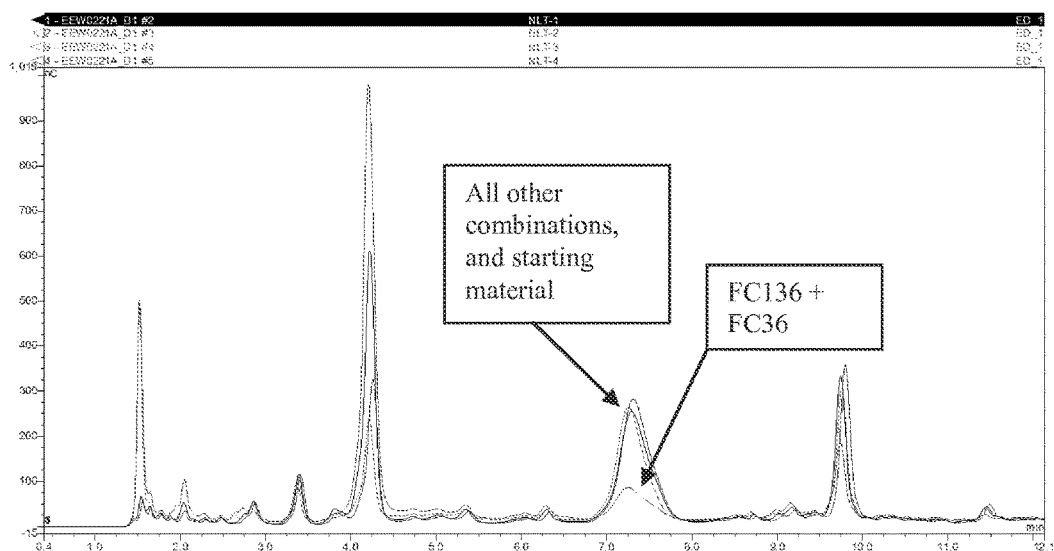
FIG. 22 depicts a fermentation of C5 liquor carried out using strain M3222, which produces FC7, FC36 and FC138. After the reaction had stopped at 144 hours of fermentation, the residuals were analyzed by HPAEC-PAD using the Dionex PA-100 column. The residuals were also subjected to hydrolysis by combinations of enzymes, including FC136 alone, FC36 alone, and the combination of FC136 and FC36.

FIG. 22 depicts the results of analyzing the residuals of a fermentation of C5 liquor carried out using the strain M3222, which produces FC7, FC36, and FC138. The fermentation was stopped at 144 hours of fermentation, with no further release of xylose or production of ethanol. To understand why this was the case, the residual sugars were analyzed by HPAEC-PAD using the Dionex PA-100 column, which can separated and the presence of various forms of oligomers detected. A large peak was observed at the elution time where xylobiose typically elutes. This was unexpected, since the xylosidase, FC36, was present in the fermentation. Thus, the residuals were also subjected to hydrolysis by several combinations of enzymes, including FC136 alone, FC36 alone, and the combination of FC136 and FC36, and the resulting material was run on the Dionex. FC136, termed an "acetyl esterase" in combination with the xylosidase allowed the peak to be hydrolyzed. This indicates that the fermentation using the acetylxylanesterase (FC7), xylanase (FC138), and xylosidase (FC36) was producing, and or leaving a compound that these three enzymes could not hydrolyze, acetylated xylobiose. The acetyl group on the compound prevents hydrolysis by xylosidase, and the short nature of the oligomer prevents the acetyl group from being removed by FC7, which acts primarily on longer chain substituted xylo-oligomers.

Figure 23:
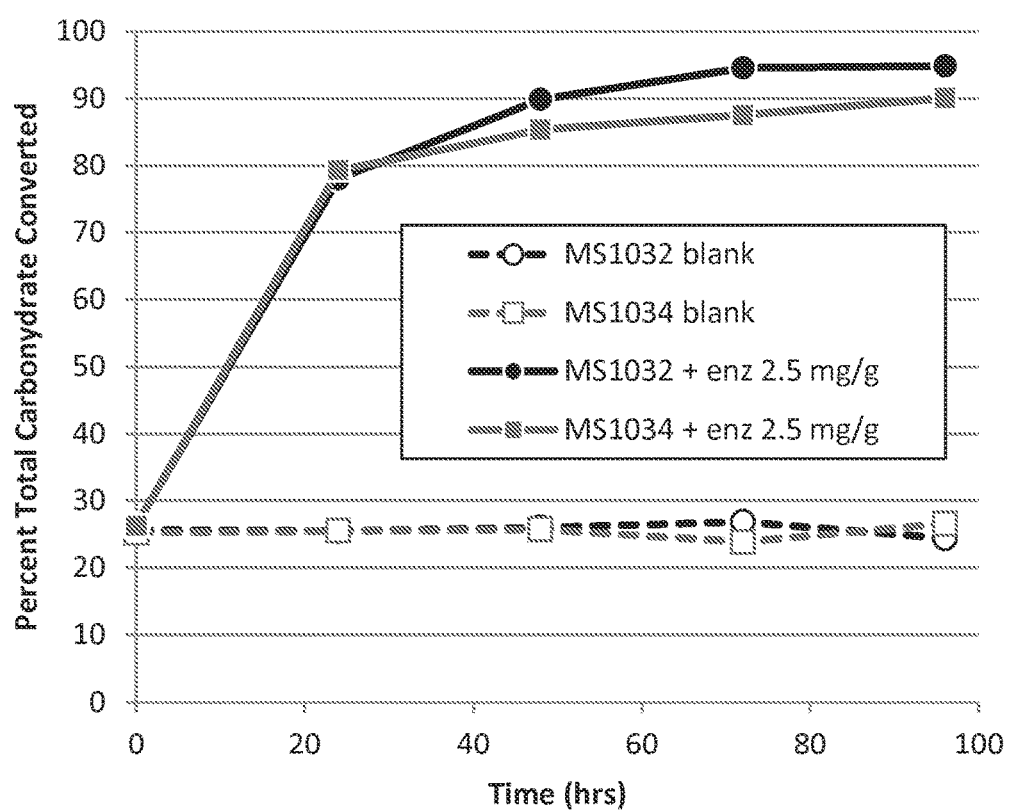
FIG. 23 depicts a time course hydrolysis of C5 liquor by a set of 11 enzymes determined from the previous experiments. Two different liquors were used in this experiment, MS1032 and MS1034. The enzyme system was made up of FC138, FC36, FC7, FC16, FC141, FC72, FC139, FC142, FC145, FC136 and FC124, and was loaded at a total of 2.5 mg enzyme protein/g xylose (xylose in starting material was determined by acid hydrolysis). FC36 was loaded at 24% of the total, FC124 was loaded at 4% of the total, and the rest of the enzymes were loaded at 8% of the total.

FIG. 23 depicts the performance of an optimized 11 enzyme system on two different C5 liquors over time. It can be seen from this figure that 80% hydrolysis can be realized using a 2.5 mg/g enzyme loading in 24 hours, and as high as 95% can be realized by 72 hours at this loading.

Example 3

Creation of Strains of S. cerevisiae Engineering for Enzyme Expression and Consolidated Bioprocessing of Hardwood Derived Soluble Oligomers As described above, a set of enzymes was discovered by screening a variety of enzyme types and several amino acid sequences for each activity type that was able to hydrolyze soluble oligomers isolated from lignocellulose very efficiently. The following set of enzymes that was chosen to use for strain engineering, based on these data.

TABLE 13

Enzymes chosen for CBP strain construction.

| FC# | Enzyme type | GH/CE family | Donor Organism | Accession # | Plasmid Reference |
|---|---|---|---|---|---|
| 7 | Acetylxylanesterase | CE1 | Neosartorya fischeri | XP_001262186 | pMU1934 |
| 16 | glucuronyl esterase | NA | Chaetomium globosum | XP_001226041 | pMU1879 |
| 36 | beta-xylosidase, his tagged | GH43 | Pyrenophora tritici-repentis | XP_001940956 (non-his tagged) | pMU2173 |
| 72 | Endoglucanase I | GH7 | Aspergillus fumigatus | XP_747897 | pMU1626 |
| 106 | alpha-glucuronidase | GH115 | Aspergillus oryzae | BAE56806 | pMU3220 |
| 124 | endo-beta-mannanase/mannosidase | GH5/GH2 | Neosartorya fischeri | XP_001262744 | pMU3131 |

Several strains were created using the approaches for integrating islands of genetic elements into S. cerevisiae as described in U.S. Appl. No. 61/557,971, filed Nov. 10, 2011, Intl Appl. No. PCT/US2012/064457, filed Nov. 9, 2012, and Intl Pub. No. WO2011/140386, which are herein incorporated by reference. The strains created to express the enzymes described in Table 13 are listed in Table 14. Table 14 lists the assembly "M'A" used to build the strain. This is a set of PCR products that when transformed into a yeast strain assemble into a genetic island and integrate the target genes for overexpression at a particular location in the genome. Table 15 provides the details of the elements of each MA, with the PCR primers and templates needed to generate each piece. Table 16 provides details on the plasmids used, and Table 17 provides the sequences of the primers detailed in Table 14.

TABLE 14

Strains of *S. cerevisiae* engineering for enzyme expression and consolidated bioprocessing of hardwood derived soluble oligomers.

| Strain # | Parental Strain | MA or plasmid (pMU) transformed | Secreted enzymes expressed/relevant characteristics |
|---|---|---|---|
| M1744 | See Reference | See reference cited in application | *S. cerevisiae*, Δura3 |
| M2390 | Wild Type | See reference cited in application | *S. cerevisiae* |
| M2108 | See Reference | See reference cited in application | Xylose utilizing, robust industrial *S. cerevisiae* strain |
| M2433 | M2108 | See reference cited in application | Glycerol reduction, acetate uptake version of M2108 |
| M3059 | M2433 | NA, Adaptation | More robust version of M2433 |
| M2874 | M2390 | See reference cited in application | Xylose utilizing, robust industrial *S. cerevisiae* strain |
| M3799 | M2874 | NA, Adaptation | More robust, faster xylose utilizing version of M2874 |
| M3222 | M2108 | MA242 | *S. cerevisiae* strain expressing *A. niger* xyn11, *P. t. repentis* xld43 and *N. fischeri* AXE |
| M3701 | M3222 | MA360a | *S. cerevisiae* strain expressing *A. niger* xyn11, *P. t. repentis* xld43, *N. fischeri* AXE, *T. reesei* alpha-galactosidase and *N. fischeri* beta-mannosidase |
| M3702 | M3222 | MA360c | *S. cerevisiae* strain expressing *A. niger* xyn11, *P. t. repentis* xld43, *N. fischeri* AXE, *T. reesei* alpha-galactosidase and *A. oryzae* alpha-glucuronidase |
| M3703 | M3059 | MA242 | *S. cerevisiae* strain expressing *A niger* xyn11, *P. t. repentis* xld43 and *N. fischeri* AXE |
| M4059 | M3703 | MA360c | *S. cerevisiae* strain expressing *A. niger* xyn11, *P. t. repentis* xld43, *N. fischeri* AXE, *T. reesei* alpha-galactosidase and *A. oryzae* alpha-glucuronidase |
| M3318 | M1744 | pMU3131 | *S. cerevisiae* strain expressing *N fischeri* beta-mannosidase |
| M2295 | M1744 | pMU2648 | *S. cerevisiae* strain expressing *A. aculeatus* beta-mannanase |
| M3240 | M2390 | MA FCY@rDNA v2 (see below MA197 in the MA database) | *S. cerevisiae* strain expressing *A. fumigatus* EG1 |
| M3460 | M3059 | MA177 | *S. cerevisiae* strain expressing *S. fibuligera* bgl |
| M4494 | M4170 | MA430i | *S. cerevisiae* strain expressing *A. fumigatus* AE16 |
| M4170 | M3799 | MA335, MA336 | *S. cerevisiae* strain marked at apt2 locus with kan/tdk marker and NAT/tdk marker. |
| M2963 | M2390 | MA162 | *S. cerevisiae* strain expressing *A. fumigatus*EG1 |
| M3918 | M3799 | MA602 | *S. cerevisiae* strain marked at gpd1 locus with kan/tdk marker and NAT/tdk marker. |
| M4044 | M3918 | MA292 | Glycerol reduction, acetate uptake version of M3799 |
| M4642 | M4044 | NA, Adaptation | More robust version of M4044 |
| M4683 | M4642 | MA509, MA510 | *S. cerevisiae* strain marked at YLR296W locus with kan/fcy1 marker and NAT/fcy1 marker. |
| M4782 | M4683 | MA548 | *S. cerevisiae* strain expressing *A. niger* xyn11, *P. t. repentis* xld43, *N. fischeri* AXE, *A. fumigatus* CE16, *T. reesei* alpha-galactosidase and *A. fumigatus* EG1 |
| M4836 | M4782 | MA513, MA514 | *S. cerevisiae* strain expressing *A. niger* xyn11, *P. t. repentis* xld43, *N. fischeri* AXE, *A. fumigatus* CE16, *T. reesei* alpha-galactosidase and *A. fumigatus* EG1 strain marked at APT2 locus with kan/fcy1 marker and NAT/fcy1 marker. |
| M5453 | M4836 | MA715 | *S. cerevisiae* strain expressing *A. niger* xyn11, *P. t. repentis* xld43, *N. fischeri* AXE, *A. fumigatus* CE16, *T. reesei* alpha-galactosidase and *A. fumigatus* EG1 |
| M4638 | M3799 | NA, Adaptation | More robust version of M3799 |
| M4679 | M4638 | MA509, MA510 | *S. cerevisiae* strain marked at YLR296W locus with kan/fcy1 marker and NAT/fcy1 marker. |
| M4777 | M4679 | MA546 | *S. cerevisiae* strain expressing *A. niger* xyn11, *P. t. repentis* xld43, *N. fischeri* AXE, *A. fumigatus* CE16, *A. oryzae* alpha-glucuronidase and *S. fibuligera* BGL |
| M4821 | M4777 | MA513, MA514 | *S. cerevisiae* strain expressing *A. niger* xyn11, *P. t. repentis* xld43, *N. fischeri* AXE, *A. fumigatus* CE16, *A. oryzae* alpha-glucuronidase and *S. fibuligera* BGL marked at APT2 locus with kan/fcy1 marker and NAT/fcy1 marker. |
| M5401 | M4821 | MA715 | *S. cerevisiae* strain expressing *A. niger* xyn11, *P. t. repentis* xld43, *N. fischeri* AXE, *A. fumigatus* CE16, *A. oryzae* alpha-glucuronidase and *S. fibuligera* BGL |

TABLE 14-continued

Strains of *S. cerevisiae* engineering for enzyme expression and consolidated bioprocessing of hardwood derived soluble oligomers.

| Strain # | Parental Strain | MA or plasmid (pMU) transformed | Secreted enzymes expressed/relevant characteristics |
|---|---|---|---|
| M3456 | M3059 | MA174 | *S. cerevisiae* strain expressing *P. t. repentis* xld43 |
| M3461 | M3059 | MA177 | *S. cerevisiae* strain expressing *S. fibuligera* BGL |
| M4477 | M4170 | MA429b | *S. cerevisiae* strain expressing *N. fischeri* AXE |
| M4495 | M4170 | MA430i | *S. cerevisiae* strain expressing *A. fumigatus* CE16 |
| M4617 | M4170 | MA431d | *S. cerevisiae* strain expressing *A. oryzae* alpha-glucuronidase |
| M4918 | M4170 | MA408H | *S. cerevisiae* strain expressing alpha-galactosidase |
| M3886 | M3059 | MA178 | *S. cerevisiae* strain expressing *N. fischeri* AXE |
| M4472 | M4170 | MA0427b | *S. cerevisiae* strain expressing *P. t. repentis* xld43 |
| M4475 | M4170 | MA0428a | *S. cerevisiae* strain expressing *A. niger* xyn11 |
| M4658 | M4472 | MA0462 | *S. cerevisiae* strain expressing *P. t. repentis* xld43 |
| M4819 | M4777 | MA513, MA514 | *S. cerevisiae* strain expressing *A. niger* xyn11, *P. t. repentis* xld43, *N. fischeri* AXE, *A. fumigatus* CE16, *A. oryzae* alpha-glucuronidase and *S. fibuligera* BGL marked at APT2 locus with kan/fcy1 marker and NAT/fcy1 marker. |
| M4888 | M4819 | MA548 | *S. cerevisiae* strain expressing 8 secreted enzymes: *A. niger* xyn11, *P. t. repentis* xld43, *N. fischeri* AXE, *A. fumigatus* CE16, *A. oryzae* alpha-glucuronidase, *S. fibuligera* BGL, *T. reesei* alpha-galactosidase and *A. fumigatus* EG1 |
| M5754 | M5401 | MA530, MA531 | *S. cerevisiae* strain expressing *A. niger* xyn11, *P. t. repentis* xld43, *N. fischeri* AXE, *A. fumigatus* CE16, *A. oryzae* alpha-glucuronidase and *S. fibuligera* BGL marked at APT2 locus with kan/fcy1 marker and NAT/fcy1 marker. |
| M5870 | M5754 | MA789 | *S. cerevisiae* strain expressing 8 secreted enzymes: *A. niger* xyn11, *P. t. repentis* xld43, *N. fischeri* AXE, *A. fumigatus* CE16, *A. oryzae* alpha-glucuronidase, *S. fibuligera* BGL, *T. reesei* alpha-galactosidase and *N. fischeri* beta-mannosidase |
| M5891 | M4170 | MA472f | *S. cerevisiae* strain expressing *N. fischeri* beta-mannosidase |

TABLE 15

DNA assemblies (MAs) used to create strains for consolidated bioprocessing of soluble oligomers.

| MA | Piece ID# | 1 | 2 | 3 | 4 | 5 |
|---|---|---|---|---|---|---|
| 242 | Description | rDNA f1 | ScADH1p-Anxyn-ScPDC1t | ScPFK1p-Nf AXE-ScHXT21t | ScENO1p-Ptrxld43-ScENO1t | TEFp-Zeo-TPI1t |
| | Primers | X16549/X16550 | X16553/X16554 | X16555/X16556 | X16557/X16558 | X16559/X16560 |
| | Template | gDNA (M2108) | pMU2816 | pMU1934 | pMU2173 | pMU2437 |
| | Size | 1985 | 2339 | 2712 | 2236 | 1244 |
| 360a | Description | Ty transposon f1 | pENO1/Nf beta-mannosidase/ENO1 t | pAgTEF/kan/ALD6 t | pADH1 | Tr AGL |
| | Primers | X13680/13684 | X17624/17625 | X17626/18206 | X18207/18179 | X18180/18181 |
| | Template | gDNA | pMU3131 | pMU2143 | gDNA | pMU2981 |
| | Size | 2279 | 2218 | 1708 | 750 | 1389 |
| 360c | Description | Ty transposon f1 | pENO1/Ao alpha-glucuronidase/ENO1 t | pAgTEF/kan/ALD6 t | pADH1 | Tr AGL |
| | Primers | X13680/13684 | X17624/17625 | X17626/18206 | X18207/18179 | X18180/18181 |
| | Template | gDNA | pMU3220 | pMU2143 | gDNA | pMU2981 |
| | Size | 2279 | 4090 | 1708 | 750 | 1389 |

TABLE 15-continued

DNA assemblies (MAs) used to create strains for consolidated bioprocessing of soluble oligomers.

| MA | Field | Col1 | Col2 | Col3 | Col4 | Col5 |
|---|---|---|---|---|---|---|
| FCY v2 | Description | rDNA 5' flank | FCY5' flank/pFBA1/EG1/HXT7 t/FCY 3' flank | AgTEFp-zeo-TPIt | FCY5' flank/pFBA1/EG1/HXT7 t/FCY 3' flank | rDNA 3' flank |
|  | Primers | X13185/16146 | X16143/16192 | X16193/16195 | X16194/16196 | 16197/13188 |
|  | Template | gDNA | M2963 gDNA | pMU2437 | M2963 gDNA | gDNA |
|  | Size | 2012 | 2724 | 1286 | 2724 | 2047 |
| 177 | Description | FCY1 f1 | pTEF1 | SFBGL | ENO2t | FCY1 f2 |
|  | Primers | X11631/11632 | X17396/X17395 | X17388/17389 | X17390/17391 | X11633/11634 |
|  | Template | gDNA | gDNA | pMU991 | gDNA | gDNA |
|  | Size | 2018 | 830 | 2725 | 283 | 2734 |
| 430i | Description | APT2 f1 | pPGK1 | Af CE16 | GND1 t | APT2 f2 |
|  | Primers | X19747/X19748 | X19790/X19798 | X19797/X19798 | X19799/X19800 | X19751/X19752 |
|  | Template | M4170 gDNA | M4170 gDNA | pMU3138 | M4170 gDNA | M4170 gDNA |
|  | Size | 2076 | 749 | 1107 | 500 | 2108 |
| 335 | Description | APT2 | TPI1p-KAN-FBA1t | HXT2p-TDK-ACT1t | APT2 |  |
|  | Primers | X18578 X18582 | X18579 X18362 | X18363 X18586 | X18588 X18589 |  |
|  | Template | M2390 gDNA | pMU2681 | pMU2623 | M2390 gDNA |  |
|  | Size | 2113 | 1834 | 2355 | 2145 |  |
| 336 | Description | APT2 | AgTEFp-ScNat-AgTEFt | pHXT7-TDK-PMA1t | APT2 |  |
|  | Primers | X18583 X18584 | X18585 X18402 | X18403 X18587 | X18590 X18589 |  |
|  | Template | M2390 gDNA | pMU2660 | pMU2874 | M2390 gDNA |  |
|  | Size | 2098 | 1266 | 2156 | 2145 |  |
| 162 | Description | FCY1 f1 | FBA1p | AfEG1 | HXT7t | FCY1 f2 |
|  | Primers | X11631/11632 | X16156/16157 | X16151/16154 | X16152/16153 | X11633/11634 |
|  | Template | M2390 gDNA | M2390 gDNA | pMU1821 | M2390 gDNA | M2390 gDNA |
|  | Size | 2018 | 681 | 1420 | 575 | 2734 |
| 602 | Primers | X16905/X16906 | X16903/X18848 | X15547/X16908 |  |  |
|  | Template | M2390 gDNA | pMU2873, pMU2879 | M2390 gDNA |  |  |
|  | Size | 1934 | 3820, 3583 | 1904 |  |  |
| 292 | Description | GPD1 5' Flank | ADH-HXT2 | pTPI-ADH-FBA1trc | GPD1 3' Flank |  |
|  | Primers | 15458/17238 | 17239/14897 | 14896/17073 | 17074/15468 |  |
|  | Template | gDNA | pMU2745 | pMU2746 | gDNA |  |
|  | Size | 1915 | 3299 | 3709 | 1906 |  |
| 509 | Description | 296W upstream | AgTEFp-kan-TPIt | FCY1t-FCY | FCY-ScURAp | 296W downstream |
|  | Primers | X20353 X20354 | X20355 X21041 | X21042 X21043 | X21044 X20356 | X20357 X20358 |
|  | Template | M2390 gDNA | pMU2877 | M2390 gDNA | pMU2877 | M2390 gDNA |
|  | Size | 2087 | 1665 | 677 bp | 742 bp | 1866 |
| 510 | Description | 296W upstream | AgTefp-ScNat-AgTeft | FCY1t-FCY | FCY-ScURAp | 296W downstream |
|  | Primers | X20353 X20354 | X20355 X21045 | X21046 X21043 | X21044 X20356 | X20357 X20358 |
|  | Template | M2390 gDNA | M3699 (pMU2660) | M2390 gDNA | pMU2877 | M2390 gDNA |
|  | Size | 2087 | 1168 | 677 bp | 742 bp | 1866 |
| 548 | Description | 296W 5' flank | Xld43 | AXE | SE34 | CYC1t |
|  | Primers | X21383 X21384 | X21385 X21386 | X21387 X21388 | X21389 X21390 | X20514 X21390 |
|  | Template | gDNA | M3456 | M4477 | M4475 | gDNA |
|  | Size | 2264 | 2430 | 2097 | 2326 | 580 bp |

TABLE 15-continued

DNA assemblies (MAs) used to create strains for consolidated bioprocessing of soluble oligomers.

| | | | | | | |
|---|---|---|---|---|---|---|
| 513 | Description | APT2 5' flank | AgTEFp-kan-TPIt | FCY1t-FCY | FCY-ScURAp | APT 3' flank |
| | Primers | X21331 X21332 | X21333 X21041 | X21042 X21043 | X21044 X21334 | X21335 X21336 |
| | Template | M2390 gDNA | pMU2877 | M2390 gDNA | pMU2877 | M2390 gDNA |
| | Size | 2087 | 1665 | 677 bp | 742 bp | 1866 |
| 514 | Description | APT2 5' flank | AgTefp-ScNat-AgTeft | FCY1t-FCY | FCY-ScURAp | APT 3' flank |
| | Primers | X21331 X21332 | X21333 X21045 | X21046 X21043 | X21044 X21334 | X21335 X21336 |
| | Template | M2390 gDNA | pMU2660 | M2390 gDNA | pMU2877 | M2390 gDNA |
| | Size | 2087 | 1168 | 677 bp | 742 bp | 1866 |
| 715 | Description | apt2 5' flank | Xld43 | SE34 | apt2 3' flank | |
| | Primers | X22464 X22465 | X22466 X22205 | X22206 X22478 | X22479 X22469 | |
| | Template | gDNA | M3456 | M4777 | gDNA | |
| | Size | 2264 | 2430 | 2326 | 2270 | |
| 546 | Description | 296W 5' flank | Xld43 | AXE | ADH1p-SE34 | CYC1t |
| | Primers | X21383 X21384 | X21385 X21386 | X21387 X21388 | X21389 X20513 | X20514 X21390 |
| | Template | gDNA | M3456 | M4477 | M4475 | gDNA |
| | Size | 2264 | 2430 | 2097 | 1780 bp | 580 bp |
| 174 | Description | FCY1 f1 | CCW12p | Ptr Xld43 | TEF2t | FCY1 f2 |
| | Primers | X11631 X11632 | X12485 X17342 | X16151 X17330 | X17331 X17332 | X11633 X11634 |
| | Template | gDNA | gDNA | pMU2173 | gDNA | gDNA |
| | Size | 2018 | 830 | 1141 | 580 | 2734 |
| 177 | Description | FCY1 f1 | TEF1p: X17396/17395 = 830 bp | SFBGL | ENO2t | FCY1 f2 |
| | Primers | X11631 X11632 | X17396 X17395 | X17388 X17389 | X17390 X17391 | X11633 X11634 |
| | Template | gDNA | gDNA | pMU991 | gDNA | gDNA |
| | Size | 2018 | 830 | 2725 | 283 | 2734 |
| 429b | Description | APT2 | pGPM412/NfAXE/PGI1 t | APT2 | | |
| | Primers | X19747 X19748 | X19762 X19763 | X19751 X19752 | | |
| | Template | M4170 gDNA | M3886 gDNA | M4170 gDNA | | |
| | Size | 2076 | 2099 | 2108 | | |
| 430i | Description | APT2 f1 | PGK1p | Af CE16 | GND1 t | APT2 f2 |
| | Primers | X19747 X19748 | X19790 X19808 | X19797 X19798 | X19799 X19800 | X19751 X19752 |
| | Template | M4170 gDNA | M4170 gDNA | pMU3138 SmaI cut | M4170 gDNA | M4170 gDNA |
| | Size | 2076 | 1067 | 1144 | 572 | 2108 |
| 431d | Description | APT2 f1 | PYK1p | Ao alpha-glucuronidase | TPI1 t | APT2 f2 |
| | Primers | X19747 X19748 | X19780 X19818 | X19812 X19813 | X19814 X19815 | X19751 X19752 |
| | Template | M4170 gDNA | M4170 gDNA | pMU3220 SmaI cut | M4170 gDNA | M4170 gDNA |
| | Size | 2076 | 1067 | 3083 | 565 | 2108 |
| 178 | Description | FCY1 f1 | GPM1-412p | CE1/AXE | PGI1 | FCY1 f2 |
| | Primers | X11631 X11632 | X 16191 X17412 | X17404 X17405 | X17406 X17407 | X11633 X11634 |
| | Template | gDNA | gDNA | pMU1934 | gDNA | gDNA |
| | Size | 2018 | 492 | 1147 | 580 | 2734 |
| 427b | Description | APT2 | pCCW12/Ptrxld43/TEF2 t | APT2 | | |
| | Primers | X19747 X19748 | X19753 X19754 | X19751 X19752 | | |
| | Template | M4170 gDNA | M3456 gDNA | M4170 gDNA | | |
| | Size | 2076 | 2434 | 2108 | | |
| 428a | Description | APT2 | pADH1/Anxyn-SE34/PDC1 t | APT2 | | |
| | Primers | X19747 X19748 | X19756 X19757 | X19751 X19752 | | |
| | Template | M4170 gDNA | pMU2816 | M4170 gDNA | | |
| | Size | 2076 | 2271 | 2108 | | |

TABLE 15-continued

DNA assemblies (MAs) used to create strains for consolidated bioprocessing of soluble oligomers.

| | | | | | | |
|---|---|---|---|---|---|---|
| 462 | Description | YLR296W 5' | pCCW12/ Ptrxld43/TEF2 t | YLR296W 3' | | |
| | Primers | X20251 X20252 | X20253 X20254 | X20255 X20256 | | |
| | Template | M4170 gDNA | M3456 gDNA | M4170 gDNA | | |
| | Size | 2264 | 2430 | 2270 | | |
| 530 | Description | IME1 5'flank | AgTEFp-kan-TPIt | FCY1t-FCY | FCY-ScURAp | IME1 3' flank |
| | Primers | X21343 X21344 | X21345 X21041 | X21042 X21043 | X21044 X21346 | X21347 X21348 |
| | Template | M2390 gDNA | pMU2877 | M2390 gDNA | pMU2877 | M2390 gDNA |
| | Size | ~2000 | 1665 | 677 bp | 742 bp | ~2000 |
| 531 | Description | IME1 5'flank | AgTefp-ScNat-AgTeft | FCY1t-FCY | FCY-ScURAp | IME1 3' flank |
| | Primers | X21343 X21344 | X21345 X21045 | X21046 X21043 | X21044 X21346 | X21347 X21348 |
| | Template | M2390 gDNA | pMU2660 | M2390 gDNA | pMU2877 | M2390 gDNA |
| | Size | ~2000 | 1168 | 677 bp | 742 bp | ~2000 |
| 789 | Description | IME1 5' | Xld43 | SE34 | mannosidase (mns) | Xld43 |
| | Primers | X21343 X22958 | X22959 X22205 | X22206 X22968 | X22969 X22970 | X23150 X22880 |
| | Template | M3799 gDNA | M3456 | M4777 | M5891 | M3456 |
| | Size | 2264 | 2430 | 2326 | 2393 | 2430 |
| | Description | APT2 f1 | Hsp150p | Nf mannosidase | GND1 t | APT2 f2 |
| | Primers | X19747 X19748 | X19784 X19805 | X19797 X19798 | X19799 X19800 | X19751 X19752 |
| | Template | M4170 gDNA | M4170 gDNA | pMU3131 SmaI cut | M4170 gDNA | M4170 gDNA |
| | Size | 2076 | 800 | 1144 | 572 | 2108 |
| 472f | Description | APT2 f1 | Hsp150p | Nf mannosidase | GND1 t | APT2 f2 |
| | Primers | X19747 X19748 | X19784 X19805 | X19797 X19798 | X19799 X19800 | X19751 X19752 |
| | Template | M4170 gDNA | M4170 gDNA | pMU3131 SmaI cut | M4170 gDNA | M4170 gDNA |
| | Size | 2076 | 800 | 1144 | 572 | 2108 |

| | Assembly Fragments, Primers, and Templates | | | | |
|---|---|---|---|---|---|
| MA | Piece ID# | 6 | 7 | 8 | 9 |
| 242 | Description | ScENO1p-Ptrxld43-ScENO1t | ScPFK1p-Nf AXE-ScHXT21t | ScADH1p-Anxyn-ScPDC1t | rDNA f1 |
| | Primers | X16561/ X16562 | X16563/ X16564 | X16565/ X16566 | X16551/ X16552 |
| | Template | pMU2173 | pMU1934 | pMU2816 | gDNA (M2108) |
| | Size | 2236 | 2712 | 2339 | 2020 |
| 360a | Description | PDC1 t | Ty transposon f2 | | |
| | Primers | X18182/ 17629 | X13681/ 13682 | | |
| | Template | gDNA | gDNA | | |
| | Size | 500 | 2122 | | |
| 360c | Description | PDC1 t | Ty transposon f2 | | |
| | Primers | X18182/ 17629 | X13681/ 13682 | | |
| | Template | gDNA | gDNA | | |
| | Size | 500 | 2122 | | |
| FCY v2 | Description Primers Template Size | | | | |
| 177 | Description Primers Template Size | | | | |
| 430i | Description Primers Template Size | | | | |

TABLE 15-continued

DNA assemblies (MAs) used to create strains for consolidated bioprocessing of soluble oligomers.

| | | | | | |
|---|---|---|---|---|---|
| 335 | Description | | | | |
| | Primers | | | | |
| | Template | | | | |
| | Size | | | | |
| 336 | Description | | | | |
| | Primers | | | | |
| | Template | | | | |
| | Size | | | | |
| 162 | Description | | | | |
| | Primers | | | | |
| | Template | | | | |
| | Size | | | | |
| 602 | Primers | | | | |
| | Template | | | | |
| | Size | | | | |
| 292 | Description | | | | |
| | Primers | | | | |
| | Template | | | | |
| | Size | | | | |
| 509 | Description | | | | |
| | Primers | | | | |
| | Template | | | | |
| | Size | | | | |
| 510 | Description | | | | |
| | Primers | | | | |
| | Template | | | | |
| | Size | | | | |
| 548 | Description | CE16 | AGL1 | EG1 | 296W 3' flank |
| | Primers | X21391 X21650 | X21651 X21652 | X21653 X21654 | X21655 X21398 |
| | Template | M4495 | M4918 | M2963 | gDNA |
| | Size | 2424 | 2540 | 2480 | 2270 |
| 513 | Description | | | | |
| | Primers | | | | |
| | Template | | | | |
| | Size | | | | |
| 514 | Description | | | | |
| | Primers | | | | |
| | Template | | | | |
| | Size | | | | |
| 715 | Description | | | | |
| | Primers | | | | |
| | Template | | | | |
| | Size | | | | |
| 546 | Description | CE16 | a-gluc | BGL | 296W 3' flank |
| | Primers | X21391 X21392 | X21393 X21394 | X21395 X21396 | X21397 X21398 |
| | Template | M4495 | M4617 | M3461 | gDNA |
| | Size | 2424 | 4371 | 3689 | 2270 |
| 174 | Description | | | | |
| | Primers | | | | |
| | Template | | | | |
| | Size | | | | |
| 177 | Description | | | | |
| | Primers | | | | |
| | Template | | | | |
| | Size | | | | |
| 429b | Description | | | | |
| | Primers | | | | |
| | Template | | | | |
| | Size | | | | |
| 430i | Description | | | | |
| | Primers | | | | |
| | Template | | | | |
| | Size | | | | |
| 431d | Description | | | | |
| | Primers | | | | |
| | Template | | | | |
| | Size | | | | |
| 178 | Description | | | | |
| | Primers | | | | |
| | Template | | | | |
| | Size | | | | |

TABLE 15-continued

DNA assemblies (MAs) used to create strains for consolidated bioprocessing of soluble oligomers.

| | 427b | Description | | | |
|---|---|---|---|---|---|
| | | Primers | | | |
| | | Template | | | |
| | | Size | | | |
| | 428a | Description | | | |
| | | Primers | | | |
| | | Template | | | |
| | | Size | | | |
| | 462 | Description | | | |
| | | Primers | | | |
| | | Template | | | |
| | | Size | | | |
| | 530 | Description | | | |
| | | Primers | | | |
| | | Template | | | |
| | | Size | | | |
| | 531 | Description | | | |
| | | Primers | | | |
| | | Template | | | |
| | | Size | | | |
| | 789 | Description | SE34 | AGL | IME1 3' |
| | | Primers | X23004 | X22973 | X22975 |
| | | | X22972 | X22974 | X21348 |
| | | Template | M4777 | M4918 | M3799 gDNA |
| | | Size | 2326 | 2326 | 2270 |
| | | Description | | | |
| | | Primers | | | |
| | | Template | | | |
| | | Size | | | |
| | 472f | Description | | | |
| | | Primers | | | |
| | | Template | | | |
| | | Size | | | |

TABLE 16

Plasmids used in strain construction.

| Plasmids | E. coli markers | E. coli replication | S. cerevisiae markers | S. cerevisiae replication | Heterologous genes expressed: Promoter/gene/terminator |
|---|---|---|---|---|---|
| pMU2816 | bla (amp) | pBR322 | ura, ble(zeo) | 2µ | pADH1/*A. niger* endo-xylanase (xyn10)/PDC1 t |
| pMU1934 | bla (amp) | pBR322 | ura, ble(zeo) | 2µ | pPFK1/*N. fischeri* AXE/HXT2 t |
| pMU2173 | bla (amp) | pBR322 | ura, ble(zeo) | 2µ | pENO1/*P. t. repentis* xld43/ENO1 t |
| pMU2437 | cat (chloramphenicol) | repB | ble(zeo) | — | — |
| pMU2981 | bla (amp) | pBR322 | ura, ble(zeo) | 2µ | pENO1/*T. reesei* AGL/ENO1 t |
| pMU3131 | bla (amp) | pBR322 | ura, ble(zeo) | 2µ | pENO1/*N. fischeri* β-mannosidase/ENO1 t |
| pMU3220 | bla (amp) | pBR322 | ura, ble(zeo) | 2µ | pENO1/*A. oryzae* α-glucuronidase/ENO1 t |
| pMU3138 | bla (amp) | pBR322 | ura, ble(zeo) | 2µ | pENO1/*A. fumigatus* CE16/ENO1 t |
| pMU2143 | bla (amp) | pMB1 | ura, kan (G418) | 2µ | pPGK1/*C. lucknowense* CBH2/ENO1 t |
| pMU991 | bla (amp) | pMB1 | ura | 2µ | No promoter/*S. fibuligera* BGL/ENO1 t |
| PMU2623 | bla (amp) | pBR322 | ura | 2µ | pAgTEF/zeo marker/AgTEF t and p |
| PMU2660 | bla (amp) | pBR322 | ura | 2µ | AgTEFp/Nat marker/AgTEFt |
| pMU2681 | bla (amp) | pBR322 | ura | 2µ | TPI1p/KAN marker/FBA1t |
| pMU2874 | bla (amp) | pMB1 | ura | 2µ | pHXT7/TDK marker/PMA1t |
| pMU2877 | bla (amp) | pMB1 | ura | 2µ | Ura3p/FCY1/Ura3t Teflp/Kan marker/TPIt |
| pMU2745 | bla (amp) | pBR322 | ura | 2µ | PFK1p *B. adolescentus* AADH pAgTEF/zeo marker/AgTEF |
| pMU2746 | bla (amp) | pBR322 | ura | 2µ | TPI1p *B. adolescentus* AADHFBA1t pAgTEF/zeo marker/AgTEF |
| pMU2873 | bla (amp) | pMB1 | ura | 2µ | Tefp/KAN marker/Teflt pHXT7/TDK marker/PMA1t |
| pMU2879 | bla (amp) | pMB1 | ura | 2µ | AgTEFp/Nat marker/AgTEFt/pHXT7/TDK marker/PMA1t |

TABLE 17

Primers used in strain construction.

| Primer Name | Sequence (5'-3') | Description |
|---|---|---|
| X11631 | TTGCCAAAGTGGATTCTCCTACTCAAGCTTTGCAAACAT | FCY1 5' flank For 2.0 KB |
| X11632 | TAGCTATGAAATTTTTAACTCTITAAGCTGGCTCTCATC AA | FCY1 5' flank Rev |
| X11633 | AGCACGCAGCACGCTGTATTTACGTAT | FCY1 3' flank For 2.7 KB |
| X11634 | TAGCCCTTGGTTGAGCTTGAGCGACGTTGAGGT | FCY1 4' flank Rev 2.7 KB |
| X11643 | tacccgggaatcagttctgttattaacgacgagccaaat tccagaaaaacagtaaggga | URA3 rev, tails for 100 bp DR |
| X12485 | gatgagagccagcttaaagagttaaaaatttcatagcta ggatgtaaaatccgacacgc | YML -5'FCY + 5' CCW12 promoter |
| X13185 | AAAGGATTTGCCCGGACAG | rDNA f1 |
| X13188 | CCAGCAAATGCTAGCACCAC | rDNA f2 |
| X13680 | CACCCACACATTTCTCATGG | TY B f1 |
| X13681 | CACACATGAGTCGTCGCACG | TY B f2 |
| X13682 | CGGAAGAGGTTTTGTCATCAC | TY B f2 |
| X13684 | GCTCGGGAATCCGCTGTGG | TY B f1 |
| X14896 | tggtggaaccatttactgtattttcaatgtaacgctaga gaataaattcaagttaaaag | FBA1t + HXT2t |
| X14897 | ACATCATCTTTTAACTTGAATTTATTCTCTAGCGTTACA TTGAAAATACAGTAAATGGT | HXT2t + FBA1t |
| X15458 | aagcctacaggcgcaagataacacat | GPD1 5' |
| X15468 | GAAACCCTCATTACGGACTTTCTCAG | GPD1 3' |
| X16143 | CGCGCGTTTCCGTATTTTCCGCTTCCGCTTCCGCAGTAA AAAATAGTGAGGAACTGGGTTACCCCTTAAAGAGTTAAA AATTTCATAGC | rDNA f1 + FCY1 f1 fragment |
| X16146 | TAGCTATGAAATTTTTAACTCTTTAAGGGGTAACCCAGT TCCTCAC | FCY f1 fragment + rDNA f1 |
| X16151 | ATGTTGTTGCAAGCTTTTTG | AfEG1 start |
| X16152 | TCAAGTTTTGAATCCATGGTACTCTCAATGCTTATAATT TGCGAACACTTTTATTAATTC | AfEG1 + HXT7 term |
| X16153 | TATAAAATTAAATACGTAAATACAGCGTGCTGCGTGCTC ATAGATGCATTGTGAAAATTG | FCY f2 + HXT7 term |
| X16154 | AATTAGAGCGTGATCATGAATTAATAAAAGTGTTCGCAA ATTATAAGCATTGAGAGTACC | HXt7 term + AfEG1 |
| X16156 | TTGATGAGAGCCAGCTTAAAGAGTTAAAAATTTCATAGC TACTACTTGGCTTCACATACG | FCY f1 + FBA1 prom |
| X16157 | CAAAACCAGCCAACAAAAACAAAAAAGCTTGCAACAACA TTTTGAATATGTATTACTTGG | AfEG1 + FBA1 prom |
| X16191 | tgatgagagccagcttaaagagttaaaaatttcatagct aaaagatactagcgcgcgcac | FCY1 f1 + GPM1-412 promoter |
| X16192 | TGCCCCTGAGCTGCGCACGTCAAGACTGTCAAGGAGGGT ATTCTGGGCCTCCATGTCGCTGGCCGGGTAAATACAGCG TGCTGCGTGCT | AgTEF prom + FCY1 f2 fragment |
| X16193 | AGCACGCAGCACGCTGTATTTACCCGGCCAGCGACATGG AG | FCY1 12 fragment + AgTEF prom |

TABLE 17-continued

Primers used in strain construction.

| Primer Name | Sequence (5'-3') | Description |
|---|---|---|
| X16194 | TTATTCATTTGAAATATAAAATTTGGGCTTCTATATTTT AATATTGCTTTTCAATTACTGTTATTAAAAAATACAGCG TGCTGCGTGCT | TPI term + FCY1 f2 fragment |
| X16195 | AGCACGCAGCACGCTGTATTTTTAATAACAGTAATTGA AAAGC | FCY1 f2 fragment + TPI term |
| X16196 | GCGACTCTCTCCACCGTTTGACGAGGCCATTTACAAAAA CATAACGAACGACAAGCCTACTCCTTAAAGAGTTAAAAA TTTCATAGCTA | rDNA f2 + FCY1 f1 fragment |
| X16197 | TAGCTATGAAATTTTTAACTCTTTAAGGAGTAGGCTTGT CGTTCGTTATG | FCY1 f1 fragment + rDNA f2 |
| X16549 | AAAGGATTTGCCCGGACAG | 5' rDNA L |
| X16550 | GGGTAACCCAGTTCCTCAC | 5' rDNA R |
| X16551 | GAGTAGGCTTGTCGTTCG | 3' rDNA L |
| X16552 | CCAGCAAATGCTAGCACCAC | 3' rDNA R |
| X16553 | CCGCTTCCGCAGTAAAAAATAGTGAGGAACTGGGTTACC CCGATTTTTTCTAAACCGTGGAATATTT | xyn 1 |
| X16554 | CCAAAGTTAGTTAGATCAGGGTAAAAATTATAGATGAGG TTTTCAATCATTGGAGCAATC | xyn 2 |
| X16555 | TGGTGCGGTCCATGTAAAATGATTGCTCCAATGATTGAA AACCTCATCTATAATTTTTACCCTGATCTA | AXE 1 |
| X16556 | TGGAAGCTCGGATCAGTAGATAACCCGCCTAGAAGACTA GGTTACATTGAAAATACAGTAAATGG | AXE 2 |
| X17073 | GAAAGTATGATATGTTATCTTTCTCCAATAAATCTACTT ATTCCCTTCGAGATTATATC | pTPI + GPD13' |
| X17074 | gttcctagatataatctcgaagggaataagtagatttat tggagaaagataacatatca | GPD13' + pTPI |
| X17238 | GGTCGGCTCTTCCTTCTTCTTTGCGTCTGCCATCTTTAT ATTATCAATATTTGTGTTTG | GPD15' + Badoles ADHe |
| X17239 | ccctccacaaacacaaatattgataatataaagatggca gacgcaaagaagaaggaaga | Badoles ADHe + GPD1 5' |
| X17330 | ggtatataaaaatattatatggaagcaataattattact cttatgaagatggaaatggag | HXT7t + xld43 |
| X17331 | ggctcaaccacaaccatatactccatttccatcttcata agagtaataattattgcttcc | xld43 + HXT7t |
| X17332 | tatataaaattaaatacgtaaatacagcgtgctgcgtgc tggggtagcgacggattaatg | FCY f2 + HXT7 |
| X17342 | caaaaccagccaacaaaaacaaaaaagcttgcaacaaca ttattgatatagtgtttaagcg | Xld43 + CCW121p |
| X16557 | CATAATAATGGTGGAACCATTTACTGTATTTTCAATGTA ACCTAGTCTTCTAGGCGGGTTATC | xld 1 |
| X16558 | TCAAGGAGGGTATTCTGGGCCTCCATGTCGCTGGCCGGG TGCAAAGAGGTTTAGACATTG | xld 2 |
| X16559 | TTCTAAGCTCAATGAAGAGCCAATGTCTAAACCTCTTTG CACCCGGCCAGCGACATGG | zeo 1 |
| X16560 | GTTCTAAGCTCAATGAAGAGCCAATGTCTAAACCTCTTT GCTTTAATAACAGTAATTGAAAAG | zeo 2 |
| X16561 | TTCTATATTTTAATATTGCTTTTCAATTACTGTTATTAA AGCAAAGAGGTTTAGACATTG | xld 3 |

TABLE 17-continued

Primers used in strain construction.

| Primer Name | Sequence (5'-3') | Description |
| --- | --- | --- |
| X16562 | CATAATAATGGTGGAACCATTTACTGTATTTTCAATGTAACCTAGTCTTCTAGGCGGGTTATC | xld 4 |
| X16563 | GTGGAAGCTCGGATCAGTAGATAACCCGCCTAGAAGACTAGGTTACATTGAAAATACAGTAAATGG | AXE 3 |
| X16564 | TTGGTGCGGTCCATGTAAAATGATTGCTCCAATGATTGAAAACCTCATCTATAATTTTTACCCTGATCTA | AXE 4 |
| X16565 | CCAAAGTTAGTTAGATCAGGGTAAAAATTATAGATGAGGTTTTCAATCATTGGAGCAATC | xyn 3 |
| X16566 | CGAGGCCATTTACAAAAACATAACGAACGACAAGCCTACTCCGATTTTTTCTAAACCGTGGAATATTT | xyn 4 |
| X17388 | ATGGTCTCCTTCACCTCCCTC | SfBGL atg |
| X17389 | AATAAGCAGAAAAGACTAATAATTCTTAGTTAAAAGCACTTCAAATAGTAAACAGGACAG | ENO2t + SfBGL |
| X17390 | TGTTAATGATATCAAGACATCTGTCCTGTTTACTATTTGAAGTGCTTTTAACTAAGAATT | SfBGL + ENO2t |
| X17391 | TATATAAAATTAAATACGTAAATACAGCGTGCTGCGTGCTGAAAAAGCCACGCGTGTGCA | FCY f2 + ENO2t |
| X17395 | TGGCGGCGACGCCGGCGAGGAGGGAGGTGAAGGAGACCATTTTGTAATTAAAACTTAGATTAG | SfBGL + TEF1p |
| X17396 | TGATGAGAGCCAGCTTAAAGAGTTAAAAATTTCATAGCTACGTCAAGGGGGCATAAGAC | FCYf1 + TEF1p |
| X17404 | atgagagctttgtctgttttttttgc | CE1/AXE atg |
| X17405 | gctttaatgttctttaggtatatatttaagagcgatttgtttataagcattgagaatacc | PG1t + CE1/AXE |
| X17406 | ttgtactgttgttaatgcttggtattctcaatgcttataaacaaatcgctcttaaatatatacc | CE1/AXE + PG1lt |
| X17407 | tatataaaattaaatacgtaaatacagcgtgctgcgtgctgcacgttaaggacggccact | FCY f2 + PG1lt |
| X17412 | agaaacagaacaaagcaaaaaaaacagacaaagctctcattattgtaatatgtgtgtttg | CE1/AXE + GPM412p |
| X17624 | GTATAACTCCATGCTATACAACCACAGCGGATTCCCGAGCGAGGTTTAGACATTGGCTCT | TyB f1 + ENO1t |
| X17624 | GTATAACTCCATGCTATACAACCACAGCGGATTCCCGAGCGAGGTTTAGACATTGGCTCT | TyB f1 + ENO1t |
| X17625 | TCAAGGAGGGTATTCTGGGCCTCCATGTCGCTGGCCGGGTCTTCTAGGCGGGTTATCTAC | AgTEFp + ENO1p |
| X17626 | CCTAGTGGAAGCTCGGATCAGTAGATAACCCGCCTAGAAGACCCGGCCAGCGACATGGAG | ENO1p + AgTEFp |
| X17629 | GAAATCTTTAGATTTACTGGCGTGCGACGACTCATGTGTGTTTCAATCATTGGAGCAATC | TyB f2 + PDC1t |
| X18179 | TATCGATGCTGTGTGGTGTCATTTAATTAATGTATATGAGATAGTTGATTGTATGCTTGG | Tr AGL/pADH1 |
| X18180 | ATACCAAGCATACAATCAACTATCTCATATACATTAATTAAATGACACCACACAGCATCG | pADH1/Tr AGL |
| X18181 | AACTTTAACTAATAATTAGAGATTAAATCGCGGCGCGCCTTAGTGGTGGTGGTGATGATG | PDC1 t/Tr AGL |
| X18182 | CTCATCATCACCACCACCACTAAGGCGCGCCGCGATTTAATCTCTAATTATTAGTTAAAG | Tr AGL/PDC1 t |

TABLE 17-continued

Primers used in strain construction.

| Primer Name | Sequence (5'-3') | Description |
|---|---|---|
| X18206 | ATCCGAAATATTCCACGGTTTAGAAAAAAATCGGTTCGA AGAAGGATGTTATTATATGAT | pADH1/ALD6 t |
| X18207 | CAGAGATCATATAATAACATCCTTCTTCGAACCGATTTT TTTCTAAACCGTGGAATATTT | ALD6 t/pADH1 |
| X18362 | CCCCCCGTTTCTTTTCTTTGGACTATCATGTAGTCTCGC TAGAGAATAAAATTCAAGTTA | FBA1t_HXT2p |
| X18363 | TTCAACATCATCTTTTAACTTGAATTTATTCTCTAGCGA GACTACATGATAGTCCAAAG | HXT2p_FBA1t |
| X18402 | TATTCCCTGGAAAAAAATTTTGCGTTGCCTTTCTGGTC GACACTGGATGGCGGCGTTA | TEFt_HXT7p |
| X18403 | GCTGTCGATTCGATACTAACGCCGCCATCCAGTGTCGAC CAGAAAGGCAACGCAAAATTT | HXT7p_TEFt |
| X18578 | AGGTCCTCATCAAGGAGGTCACCAGTAATTGTGCGCTT | APT25' flank F |
| X18579 | AAGGAAAGGAAAATAATTGAAGGAGGAGGCAGAGAACCT ACTTATTCCCTTCGAGATTA | TPI1_5' APT2 flank |
| X18582 | ATGGGTTCCTAGATATAATCTCGAAGGGAATAAGTAGGT TCTCTGCCTCCTCCTTCAAT | 5' APT2 flank_TPI1p |
| X18583 | GAGGTCACCAGTAATTGTGCGCTTTGGTTACATTTTGTT GTACAGTAATGGGCGGTCAAG | APT25' flank F_alt |
| X18584 | CGCTGGCCGGGTGACCCGGCGGGGACAAGGCAAGCTGTT CTCTGCCTCCTCCTTCAAT | 5' APT2 flank_TEFp |
| X18585 | AAGGAAAGGAAAATAATTGAAGGAGGAGGCAGAGAACAG CTTGCCTTGTCCCCGCCGGG | TEFp_5' APT2 |
| X18586 | GTGTATATGCCTGTTCATTGCCTGTCCGCCTCTCATTGT TTTGATTTGGTTCCCAGAAA | ACT1_3' APT2 |
| X18587 | GTGTATATGCCTGTTCATTGCCTGTCCGCCTCTCATTAA ATTAGTGTGTGTGCATTATA | PMA1t_3' APT2 |
| X18588 | TGCTCATACCCTTTGTTTCTGGGAACCAAATCAAAACAA TGAGAGGCGGACAGGCAATG | 3' APT2_ACT1t |
| X18589 | ACTAATCAAAGTCAAACACGACTCTCAGCCATTTATTAA GTTCCTCAATTTTCGCCCTCC | APT23' flank F |
| X18590 | TTAATTTTTAATATATATAATGCACACACACTAATTTAA TGAGAGGCGGACAGGCAATG | 3' APT2_PMA1t |
| X19747 | AGGTCCTCATCAAGGAGGTCACCAGTAATTGTGCGCTT | APT2-1 |
| X19748 | GTTCTCTGCCTCCTCCTTCAAT | APT2-2 |
| X19751 | AATGAGAGGCGGACAGGCAATG | APT2-3 |
| X19752 | ACTAATCAAAGTCAAACACGACTCTCAGCCATTTATTAA GTTCCTCAATTTTCGCCCTCC | APT2-4 |
| X19753 | gcgaaggaaaggaaaataattgaaggaggaggcagagaa cggatgtaaaatccgacacgc | pCCW12/xld43-1 |
| X19754 | tgcgtgtgtatatgcctgttcattgcctgtccgcctctc attggggtagcgacggattaa | TEF2 t/xld43-2 |
| X19756 | aaggaaaataattgaaggaggaggcagagaaccgatttt tttctaaaccgtggaatattt | pADH1/Anxyn11-1 |
| X19757 | cgtgtgtatatgcctgttcattgcctgtccgcctctcat ttttcaatcattggagcaatc | PDC1 t/Anxyn11-2 |
| X19762 | gcgaaggaaaggaaaataattgaaggaggaggcagagaa caaagatactagcgcgcgcac | pGPM-412/NfAXE-1 |

TABLE 17-continued

Primers used in strain construction.

| Primer Name | Sequence (5'-3') | Description |
|---|---|---|
| X19763 | cgtgtgtatatgcctgttcattgcctgtccgcctctcat tgcacgttaaggacggccact | PGl1 t/NfAXE-2 |
| X19784 | gcgaaggaaaggaaaataattgaaggaggaggcagagaa cggaacaaatgcaccaaactg | apt2-pHSP150 |
| X19790 | AGGAAAGGAAAATAATTGAAGGAGGAGGCAGAGAACCGC ACAGATATTATAACATCTGCA | apt2-pPGK1 |
| X19797 | TTATTCTTCTTAATAATCCAAACAAACACACATATTACA ATAATGCATCGGTGGCAATTG | AfCE16 |
| X19798 | AAATTTTTTTGGTTTATGTCCAGGTTGGAGATTTCCTTT AGTGGTGGTGGTGATGATGAG | GND1 t-AfCE16 |
| X19799 | AAGGTGGTTCTCCTCCTTCTCATCATCACCACCACCACT AAAGGAAATCTCCAACCTGGA | AfCE16-GND1 t |
| X19800 | ATGCCTGTTCATTGCCTGTCCGCCTCTCATTATAAAAAT TCTTGTTAAATATTTCAGGAA | apt2-GND1 t |
| X19805 | caaaaacaagccctagaagcaattgccaccgatgcattt atattattattattgtactag | AfCE16-pHSP150 |
| X19808 | AAACAAGCCCTAGAAGCAATTGCCACCGATGCATTGTTT TATATTTGTTGTAAAAAGTAG | AfCE16-pPGK1 |
| X19812 | atgaagctgatttggcctacg | Alpha-glucuronidase |
| X19813 | tcatcatcaccaccaccactaagattaatataattatat aaaaatattatcttctttttct | TPI1 t-Alpha-glucuronidase |
| X19814 | tccttctcatcatcaccaccaccactaagattaatataa ttatataaaaatattatcttc | Alpha-glucuronidase-TPI1 t |
| X19815 | gtgtatatgcctgttcattgcctgtccgcctctcatttt taataacagtaattgaaaagc | apt2-TPI1 t |
| X19818 | gggccgtaaagagaagagacgtaggccaaatcagcttca ttgtgatgatgttttatttgt | Alpha-glucuronidase-pPYK1 |
| X20251 | gttgcatcaattgttcatcgacttggacttctggtgggg ctaaagctggagaagcaacaa | YLR296W5 F |
| X20252 | cctcgaaggttttcttttgcgtgtcggattttacatcca tagaatctgacgacgtaagga | YLR296W5 R |
| X20253 | gtttcccgcttttcttctccttacgtcgtcagattcta tggatgtaaaatccgacacgc | xld43-1 |
| X20254 | acaaggtgtgcaattgttatgagtaggattcagttataa ttaggggtagcgacggattaa | xld43-2 |
| X20255 | tcccaacaacaagtatgccattaatccgtcgctaccccct aattataactgaatcctactc | YLR296W3 F |
| X20256 | gatataatatgagctcctagtgtaggcgatgaaggtgct caagtaa | YLR296W3 R |
| X20353 | ggccaaccataagaaagg | F_298W 5' (tailless) |
| X20354 | CAAGGAGGGTATTCTGGGCCTCCATGTCGCTGGCCGGGT ATAGAATCTGACGACGTAAG | R_296W 5' (tail to AgTEFp) |
| X20355 | gtttcccgcttttcttctccttacgtcgtcagattcta tacccggccagcgacatggag | F_AgTefp (tail to 296W 5') |
| X20356 | GGTGTGCAATTGTTATGAGTAGGATTCAGTTATAATTAG GCATCAGAGCAGATTGTAC | R_Ura3p (tail to 296W 3') |
| X20357 | gtggtatggtgcactctcagtacaatctgctctgatgcc taattataactgaatcctac | F_296W 3' (tail to Ura3 promoter) |
| X20358 | GAACTGGCACAAACCTC | R_296W 3' (tailless) |

TABLE 17-continued

Primers used in strain construction.

| Primer Name | Sequence (5'-3') | Description |
|---|---|---|
| X20513 | CATAACTAATTACATGATATCGACAAAGGAAAAGGGGCCTGTCGCGCCTTATAACTAGAG | R_SE34 (overhang to CYC1t) |
| X20514 | catacactgctatcgcaaatgctctctagttataaggcgcgacaggccccttttcctttg | F_CYC1t (overhang to SE34) |
| X21041 | GCCTACTGCTTAGCTGTTTCCGTCTCTACTTCTTTAATAACAGTAATTGAAAAGC | R_TPIt with overhang to FCY1t |
| X21042 | cttctatattttaatattgcttttcaattactgttattaaagaagtagagacggaaacag | F_FCTt with overhang to TPIt |
| X21043 | CATGGTGACAGGGGGAATGG | R_FCY |
| X21044 | ctactcaccaatatcttc | F_FCY |
| X21045 | GGATAAGCCTACTGCTTAGCTGTTTCCGTCTCTACTTCTCGACACTGGATGGCGGCG | R_Teft with overhang to FCY1t |
| X21046 | gctgtcgattcgatactaacgccgccatccagtgtcgagaagtagagacggaaacagc | F_FCTt with overhang to Teft |
| X21331 | gactcattcattatgtcgtc | F_APT2 5' flank |
| X21332 | GTCAAGGAGGGTATTCTGGGCCTCCATGTCGCTGGCCGGGTGTTCTCTGCCTCCTCCTTC | R_APT2 with overhang to AgTef promoter |
| X21333 | gcgaaggaaaggaaataattgaaggaggaggcagagaacacccggccagcgacatggag | F_AgTefp with overhang to APT2 5' flank |
| X21334 | CGTGTGTATATGCCTGTTCATTGCCTGTCCGCCTCTCATTGGCATCAGAGCAGATTGTAC | R_ScUra3p with overhang to APT2 3' flank |
| X21335 | ggtatggtgcactctcagtacaatctgctctgatgccaatgagaggcggacaggcaatg | F_APT2 3' flank with overhang to Ura3p |
| X21336 | GAAGATTGTCTGTCATTTGCGC | R_APT2 3' flank |
| X21343 | gtccactaaatggcagtaaatg | F_IME1 5' flank |
| X21344 | GTCAAGGAGGGTATTCTGGGCCTCCATGTCGCTGGCCGGGTTTTGTTTGTGGGGAGAGG | R_IME1 with overhang to AgTef promoter |
| X21345 | gcttttctattcctctccccacaaacaaaacccggccagcgacatggag | F_AgTefp with overhang to IME1 5' flank |
| X21346 | GAGGGAAGGGGGAAGATTGTAGTACTTTTCGAGAAGGCATCAGAGCAGATTGTAC | R_ScUra3p with overhang to IME1 3' flank |
| X21347 | gtggtatggtgcactctcagtacaatctgctctgatgccttctcgaaaagtactacaatc | F_IME1 3' flank with overhang to Ura3p |
| X21348 | GCCTTTGAACAATTTCCC | R_IME1 3' flank |
| X21383 | gcttgttctcgtttgtccc | F_YLR296W 5' flank |
| X21384 | CCTCGAAGGTTTTCTTTTGCGTGTCGGATTTTACATCCATAGAATCTGACGACGTAAG | R_YLR29W 5' flankoverhang to Xld43 |
| X21385 | gtttcccgcttttcttctccttacgtcgtcagattctatggatgtaaaatccgacacgc | F_Xld43 with overhang to YL269W 5' flank |
| X21386 | GACGAAGCTTGTGTGTGGGTGCGCGCGCTAGTATCTTTGGGGTAGCGACGGATTAATG | R_Xld43 OH to Axe |
| X21387 | cccaacaacaagtatgccattaatccgtcgctacccaaagatactagcgcgcgc | F_AXE OH Xld43 |

TABLE 17-continued

Primers used in strain construction.

| Primer Name | Sequence (5'-3') | Description |
|---|---|---|
| X21388 | GAAACAACAAAAGGATATCCGAAATATTCCACGGTTTAGAAGCACGTTAAGGACGGCCAC | R_AXE OH SE34 |
| X21389 | ctaaacacgaattcaacaaagtggccgtccttaacgtgcttctaaaccgtggaatatttc | F_SE34 OH Axe |
| X21045 | GGATAAGCCTACTGCTTAGCTGTTTCCGTCTCTACTTCTCGACACTGGATGGCGGCG | R_Teft with overhang to FCY1t |
| X21046 | gctgtcgattcgatactaacgccgccatccagtgtcgagaagtagagacggaaacagc | F_FCTt with overhang to Teft |
| X21331 | gactcattcattatgtcgtc | F_APT2 5' flank |
| X21332 | GTCAAGGAGGGTATTCTGGGCCTCCATGTCGCTGGCCGGGTGTTCTCTGCCTCCTCCTTC | R_APT2 with overhang to AgTef promoter |
| X21333 | gcgaaggaaaggaaaataattgaaggaggaggcagagaacacccggccagcgacatggag | F_AgTefp with overhang to APT2 5' flank |
| X21334 | CGTGTGTATATGCCTGTTCATTGCCTGTCCGCCTCTCATTGGCATCAGAGCAGATTGTAC | R_ScUra3p with overhang to APT2 3' flank |
| X21335 | ggtatggtgcactctcagtacaatctgctctgatgccaatgagaggcggacaggcaatg | F_APT2 3' flank with overhang to Ura3p |
| X21336 | GAAGATTGTCTGTCATTTGCGC | R_APT2 3' flank |
| X21383 | gcttgttctcgtttgtccc | F_YLR296W 5' flank |
| X21384 | CCTCGAAGGTTTTCTTTTGCGTGTCGGATTTTACATCCATAGAATCTGACGACGTAAG | R_YLR29W 5' flankoverhang to Xld43 |
| X21385 | gtttcccgcttttcttctccttacgtcgtcagattctatggatgtaaaatccgacacgc | F_Xld43 with overhang to YL269W 5' flank |
| X21386 | GACGAAGCTTGTGTGTGGGTGCGCGCGCTAGTATCTTTGGGGTAGCGACGGATTAATG | R_Xld43 OH to Axe |
| X21387 | cccaacaacaagtatgccattaatccgtcgctaccccaaagatactagcgcgcgc | F_AXE OH Xld43 |
| X21388 | GAAACAACAAAAGGATATCCGAAATATTCCACGGTTTAGAAGCACGTTAAGGACGGCCAC | R_AXE OH SE34 |
| X21389 | ctaaacacgaattcaacaaagtggccgtccttaacgtgcttctaaaccgtggaatatttc | F_SE34 OH Axe |
| X21390 | GCAAATGCCTATTATGCAGATGTTATAATATCTGTGCGGTCGACAACTAAACTGGAATG | R_SE34 OH CE16 |
| X21391 | gacttttgttgttccctcacattccagtttagttgtcgaccgcacagatattataacatc | F_CE16 OH SE34 |
| X21392 | GCCGGAAAAACTTTCGGGTAGCGAAAATCTTTCTGCCCTTGTTAAATATTTCAGGAAC | R_CE16 OH a-Gluc |
| X21393 | ccaccaaggagaggaggatgttcctgaaatatttaacaagggcagaaagattttcgctac | F_A-gluc OH CE16 |
| X21394 | CAGATGGGGATGACCGTAGTCTTATGCCCCCTTGACGTTTAATAACAGTAATTGAAAAGC | R_A-gluc OH BGL |
| X21395 | cttctatattttaatattgcttttcaattactgttattaaacgtcaaggggggcataagac | F_BGL OH A-gluc |
| X21396 | CAAGGTGTGCAATTGTTATGAGTAGGATTCAGTTATAATTACCCTTCCAGTGCATTATGC | R_BGL OH YLR296W 3' flank |

TABLE 17-continued

Primers used in strain construction.

| Primer Name | Sequence (5'-3') | Description |
|---|---|---|
| X21397 | caaagactcgtgctgtctattgcataatgcactggaagg gtaattataactgaatcctac | F_YLR296W 3' flank OH BGL |
| X21398 | CATAGGCGGGTAAGCGTTAAGG | R_YLR296W 3' flank |
| X21650 | ATTACTGCTTTAGGTCATCCACCACGGGTAGTGTTGAGG ATTCTTGTTAAATATTTCAGG | R_CE16 cassette (GND1t) with overhang to AGL cassette (Sed1p) |
| X21651 | caccaaggagaggaggatgttcctgaaatatttaacaag aatcctcaacactacccgtgg | F_AGL cassette (Sed1p) with overhang to CE16 cassette (GND1t) |
| X21652 | CTATATCGACGTATGCAACGTATGTGAAGCCAAGTAGAT TTAGGACACTAATTGAATC | R_AGL cassette (PYK1t) with overhang to EG1 cassette (FBA1p) |
| X21653 | gacgcgggcagattcaattagtgtcctaaatctacttgg cttcacatacg | F_EG1 cassette (FBA1p) with overhang to AGL cassette (PYK1t) |
| X21654 | GGTGTGCAATTGTTATGAGTAGGATTCAGTTATAATTAC ATAGATGCATTGTGAAAATTG | R_EG1 cassette (PYK1t) with overhang to 296W |
| X21655 | gcttcaattttcacaatgcatctatgtaattataactga atcctactc | F_296W 3' flank with overhang to EG1 cassette (PYK1t) |
| X22205 | ggaaacaacaaaaggatatccgaaatattccacggttta gaaggggtagcgacggattaa | R_xld43 OH SE34 |
| X22206 | atcccaacaacaagtatgccattaatccgtcgctacccc ttctaaaccgtggaatatttc | F_SE34 OH xld43 |
| X22464 | aggtcctcatcaaggaggtcaccagtaattgtgcgctt | F_apt2 5' flank |
| X22465 | cctcgaaggttttcttttgcgtgtcggattttacatccg ttctctgcctcctccttcaat | R_apt2 OH pCCW12 |
| X22466 | gcgaaggaaaggaaataattgaaggaggaggcagagaa cggatgtaaaatccgacacgc | F_xld43 OH apt2 |
| X22469 | ACTAATCAAAGTCAAACACGACTCTCAGCCATTTATTAA GTTCCTCAATTTTCGCCCTCC | R_apt2 3' flank |
| X22478 | gtgtgtatatgcctgttcattgcctgtccgcctctcatt gtcgacaactaaactggaatg | R_SE34 OH apt2 3' flank |
| X22479 | cttttgttgttccctcacattccagtttagttgtcgaca atgagaggcggacaggcaatg | F_apt2 3' flank OH SE34 |
| X22880 | GACTTTTGTTGTTCCCTCACATTCCAGTTTAGTTGTCGA CGGATGTAAAATCCGACACGC | R_Ccw12p with OH to Cyc1t |
| X22958 | gcaacctcgaaggttttcttttgcgtgtcggattttaca tcctttgtttgtgggagagg | R_IME1 OH pCCW12 |
| X22959 | ataaagaaaagcttttctattcctctccccacaaacaa aggatgtaaaatccgacacgc | F_xld43 OH IME1 |
| X22968 | ttttgcagaatagatcaacagtttggtgcatttgttcc gtcgacaactaaactggaatg | R_SE34 OH mns |
| X22969 | gacttttgttgttccctcacattccagtttagttgtcga cggaacaaatgcaccaaactg | F_mns OH SE34 |
| X22970 | aacaacaagtatgccattaatccgtcgctaccccactg ctatgtatgttgaatcatgtt | R_mns OH xld43 |

TABLE 17-continued

Primers used in strain construction.

| Primer Name | Sequence (5'-3') | Description |
|---|---|---|
| X22972 | ttactgctttaggtcatccaccacgggtagtgttgagga ttctaaaccgtggaatatttc | R_SE34 OH AGL1 |
| X22973 | aaacaacaaaaggatatccgaaatattccacggtttaga atcctcaacactacccgtggt | F_AGL1 OH SE34 |
| X22974 | gagggaaggggggaagattgtagtactttcgagaaattt aggacactaattgaatctgcc | R_SE34 OH IME1 3' flank |
| X22975 | taaaaaatgacgcgggcagattcaattagtgtcctaaat ttctcgaaaagtactacaatc | F_IME1 3' flank OH AGL1 |
| X23004 | acctcgaaggttttcttttgcgtgtcggattttacatcc gtcgacaactaaactggaatg | Corrected primer for 22881 (CYC1 t F OH pCCW12) |
| X23150 | gtagactatccacacaaacatgattcaacatacatagca gtgggggtagcgacggattaa | F xld43rev OH mns |

Once a strain had been transformed with a particular MA, several colonies were isolated from that transformation for further testing. The colonies were screened by measuring their growth rates in xylose containing media (YPX) under anaerobic conditions (i.e., in an anaerobic chamber) in a Biotek 96 well plate reader equipped with the ability to incubate and shake. Measurements of optical density at 600 nm were taken every 10 minutes for 48 hours and strains were compared against each other. The colonies were also screened for their ability to produce the hydrolytic activity against C5 liquor as well as against substrates specific to the enzymes expressed (see Table 5 and following protocols). Once the top colonies from a particular transformation had been isolated, they were tested in small nitrogen flushed pressure bottles for their ability to directly convert C5 liquor to ethanol. After this final screen, top colonies were stocked in the freezer and given the name as listed in Table 14.

Figure 24:
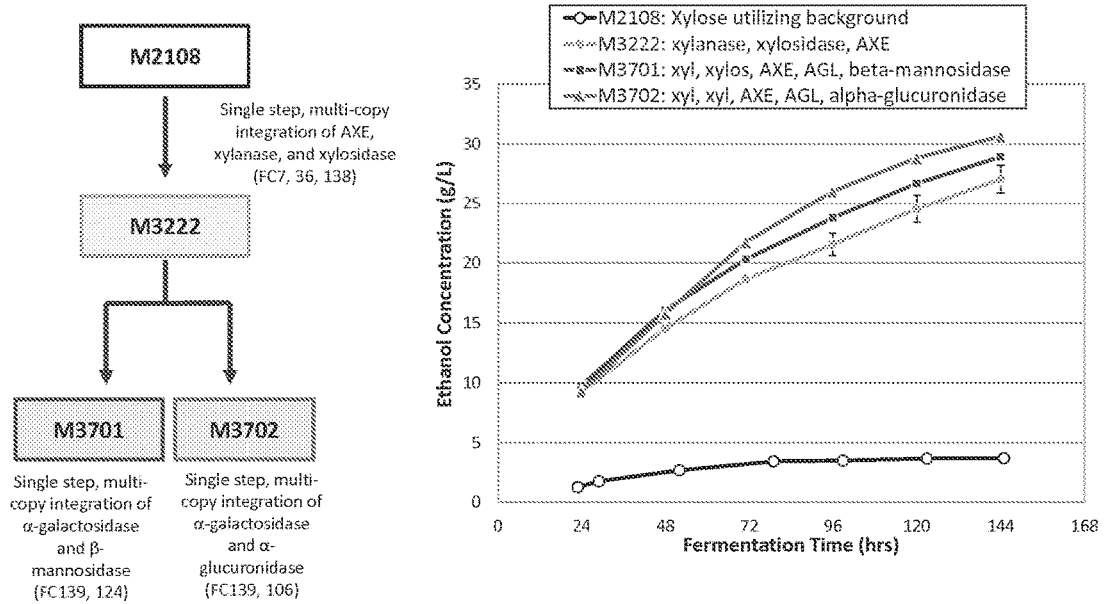
FIG. 24 depicts the performance of CBP strains expressing different combinations of hemicellulose enzymes in hydrolyzing and fermenting hardwood derived soluble oligomers (Substrate=MS712D, approximately 120 g/L total sugars loaded as determined by acid hydrolysis). The experiment was carried out as a fed batch of concentrated oligomers in 2 L working volume reactor with pH controlled at 5.5, temperature controlled at 35° C., and agitation at 300 rpm.
Figure 25:
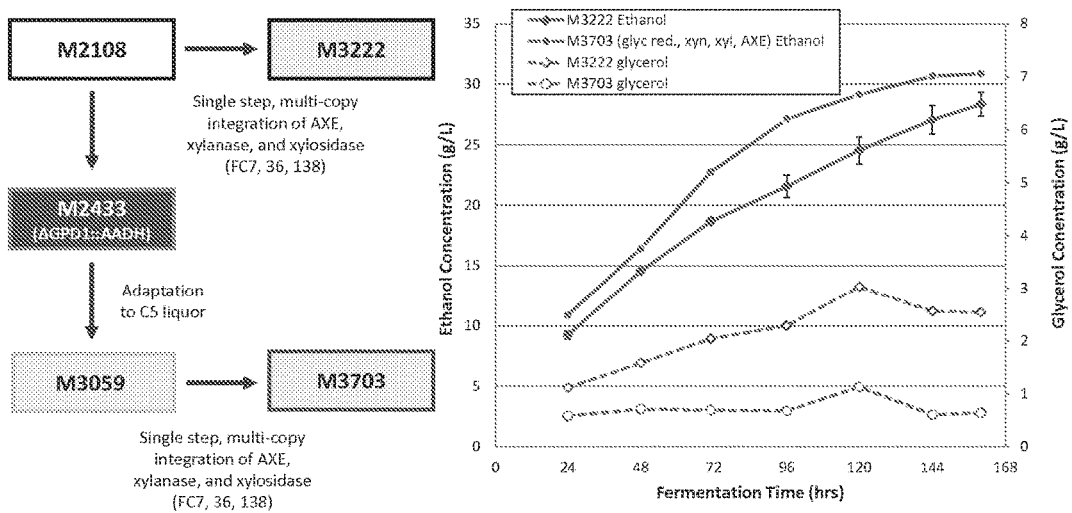
FIG. 25 depicts the performance of CBP strains with and without glycerol reduction technology in hydrolyzing and fermenting hardwood derived soluble oligomers (Substrate=MS712D, ~120 g/L sugars loaded as assessed by acid hydrolysis of starting material). The experiment was carried out as a fed batch of concentrated oligomers in 2 L working volume reactor with pH controlled at 5.5, temperature controlled at 35° C., and agitation at 300 rpm.

These strains were then tested in 2 L bioreactors in a fed-batch C5 liquor fermentation, and the results are presented in FIGS. 24-27. FIG. 24 demonstrates several important points. The xylose utilizing, robust background strain M2108 is shown in the black circles, and clearly is not able to produce substantial ethanol from this oligomeric solution. A single transformation with FC7, FC36, and FC138 (xylanase, xylosidase, and acetylxylanesterase) yielded strain M3222, produced >25 g/L of ethanol, or approximately 50% of theoretical hydrolysis yield of oligomers, where M2108 produced <5 g/L. This shows that the production of these hemicellulolytic enzymes in S. cerevisiae backgrounds capable of xylose utilization results in strains capable of direct conversion of substituted oligomers to ethanol. FIG. 25 also shows the performance of strain M3701, where FC139 and FC124 (α-galactosidase and β-mannosidase/mannase) have been transformed on top of the previously expressed enzymes. This strain produced ~2 g/L more ethanol than M3222, which corresponds to ~53% of theoretical hydrolysis yield of oligomers. Strain M3702 is also shown in FIG. 24. This strain expresses FC139 and FC106 (α-galactosidase and α-glucuronidase) and achieves ~4 g/L more ethanol than M3222, or ~58% conversion of oligomers.

FIG. 25 demonstrates the performance of strains expressing the combination of FC7, FC36, and FC138 (xylanase, xylosidase, and acetylxylanesterase) in either a xylose utilizing background (M3222) or one that has been engineered for glycerol reduction (M3703). The glycerol reduction pathway in this strain utilizes the acetate present in the stream to displace glycerol production, and this technology has been described in Int'l Pub. No. WO2011/140386. Example 1, above described how the strain M2433 was adapted to be more robust for C5 liquor fermentation. FIG. 25 shows that the combination of the glycerol reduction technology and the enzyme expression technology results in a significant benefit in performance, yielding a strain that realized a significant yield increase over M3222 of 14%. As FIG. 25 demonstrates, the glycerol yield of the strain M3703 has been substantially decreased relative to M3222, with the strain making approximately 5 fold less glycerol in the same reaction.

Figure 26:
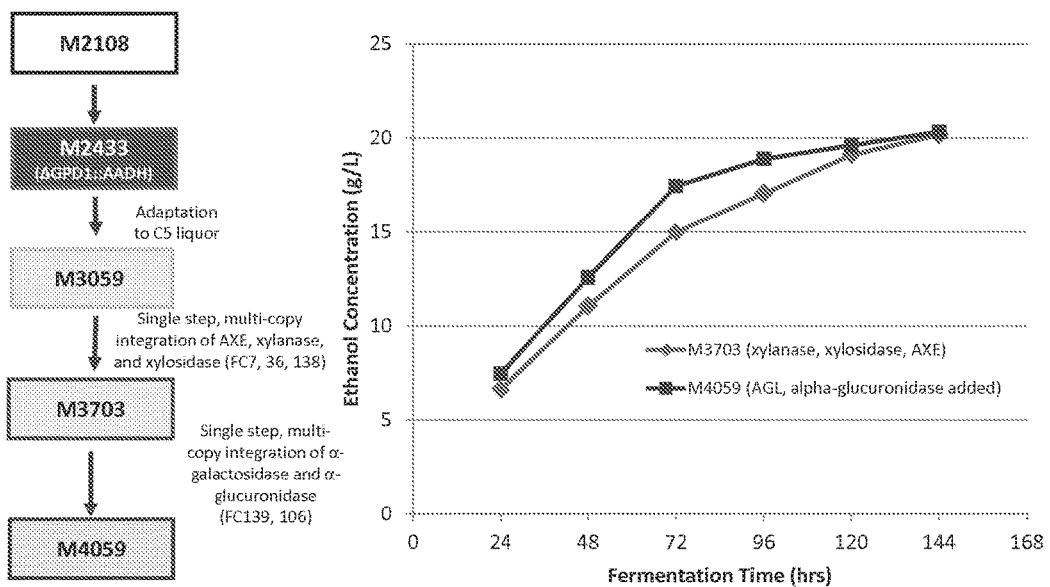
FIG. 26 depicts the improvement of CBP strains with glycerol reduction technology and expression of five enzymes in hydrolyzing and fermenting hardwood derived soluble oligomers (Substrate=MS1062-CC-100-A, approximately 75 g/L total sugars loaded as determined by acid hydrolysis of the starting material), compared to expression of three enzymes. The experiment was carried out as a fed batch of concentrated oligomers in 2 L working volume reactor with pH controlled at 5.5, temperature controlled at 35° C., and agitation at 300 rpm.

FIG. 26 presents data on the combination of the 5 enzyme system (FC7, FC36, FC138, FC139, and FC106) in a glycerol reduction background (M4059). This strain was compared against M3703, which produces 3 enzymes. As the figure shows, the rate of ethanol production is higher for M4059 than for M3703, although the strains end up achieving the same overall ethanol yield. In this fermentation, the 20 g/L of ethanol yield produced is the equivalent of ~58% of theoretical hydrolysis yield, with an assumed fermentation yield of 0.46 g ethanol produced per gram of carbohydrate consumed.

Figure 27:
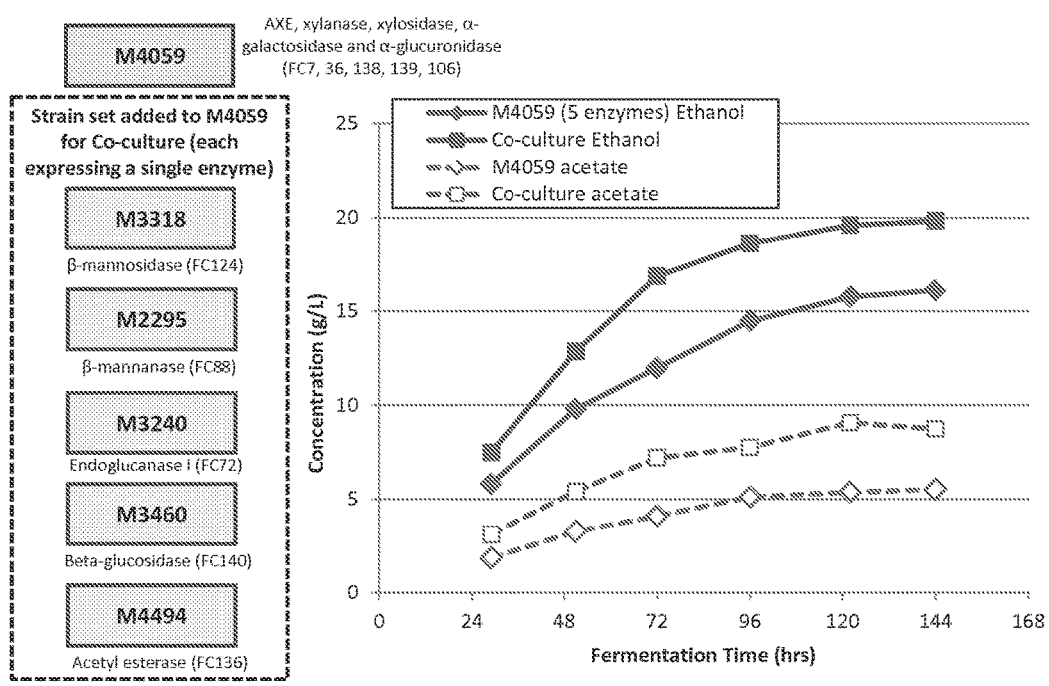
FIG. 27 depicts the performance of a co-culture of CBP strains, five expressing a single enzyme, combined with a strain (M4059) expressing five enzymes, in hydrolyzing and fermenting hardwood derived soluble oligomers (Substrate=MS1062-CC-100-A, ~61 g/L of total sugars loaded as determined by acid hydrolysis of the starting material), compared to expression of three enzymes. The experiment was carried out as a fed batch of concentrated oligomers in 2 L working volume reactor with pH controlled at 5.5, temperature controlled at 35° C., and agitation at 300 rpm.
Figure 28:
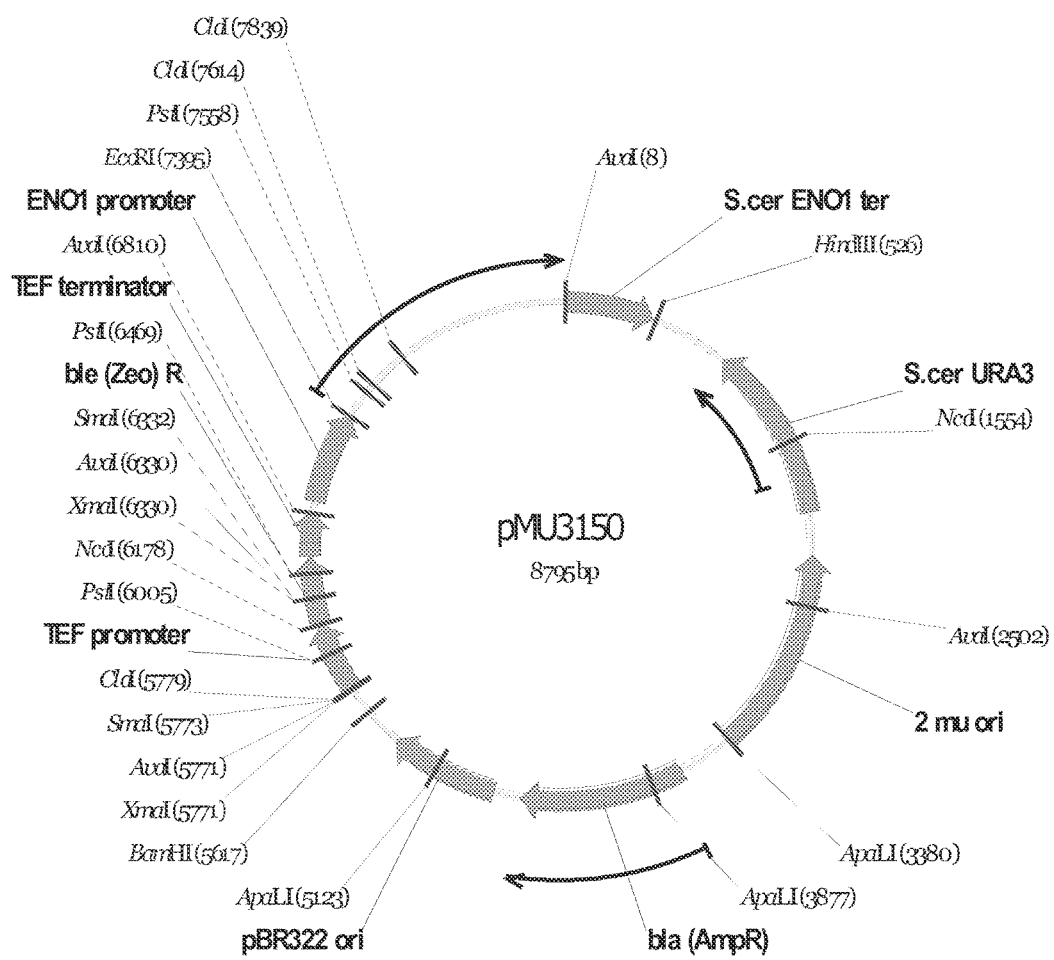
FIG. 28 depicts a plasmid map for pMU3150.
Figure 29:
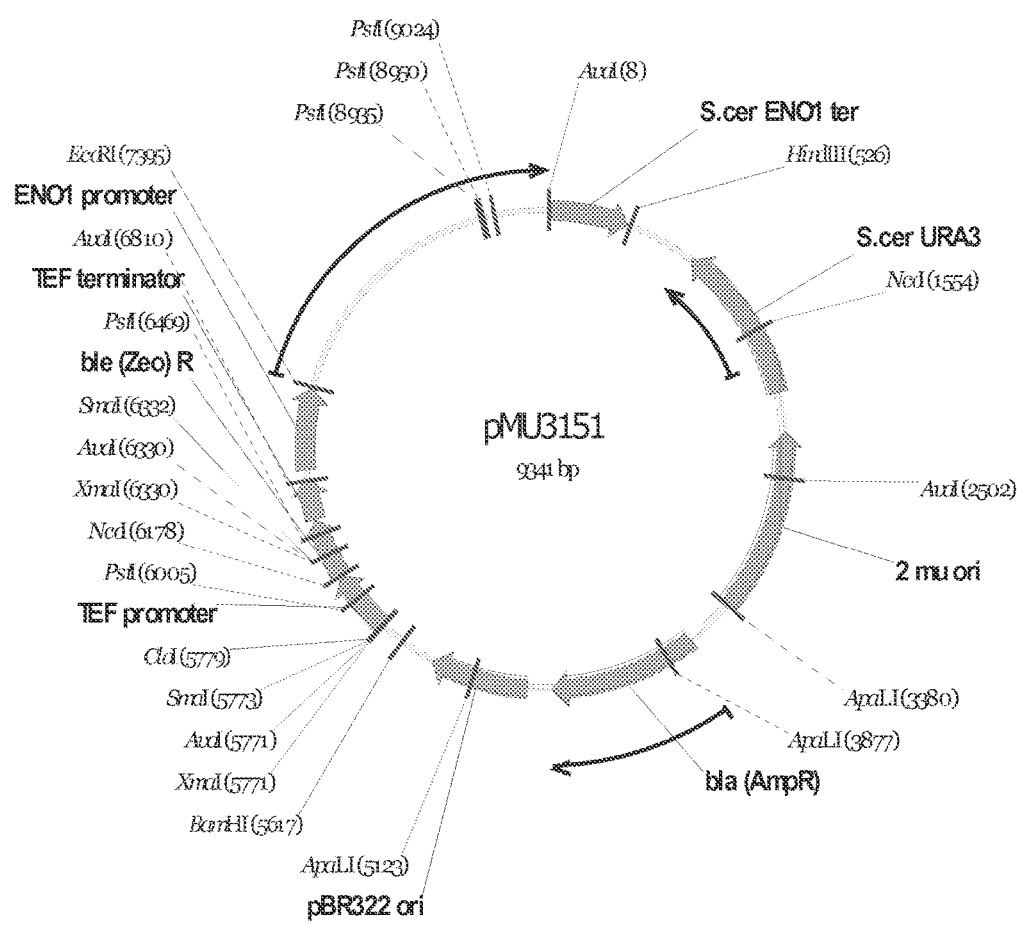
FIG. 29 depicts a plasmid map for pMU3151.
Figure 30:
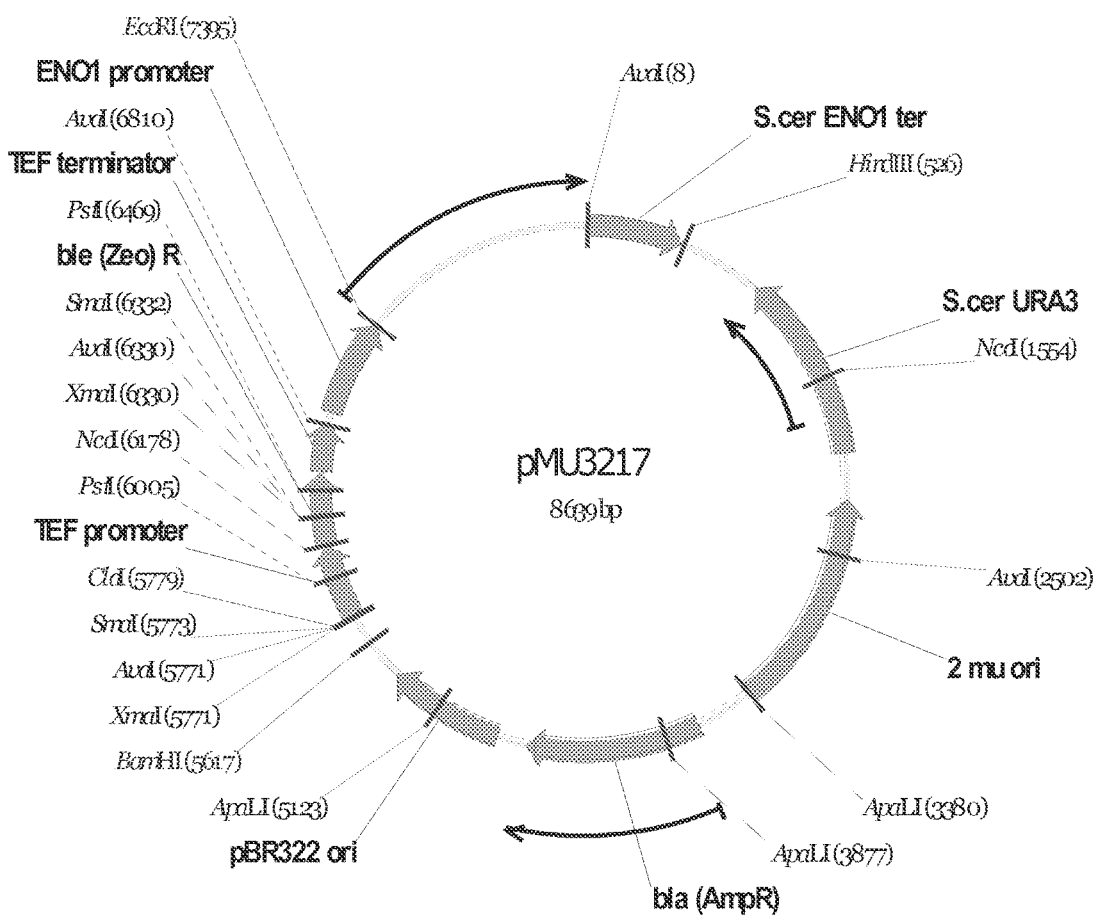
FIG. 30 depicts a plasmid map for pMU3217.
Figure 31:
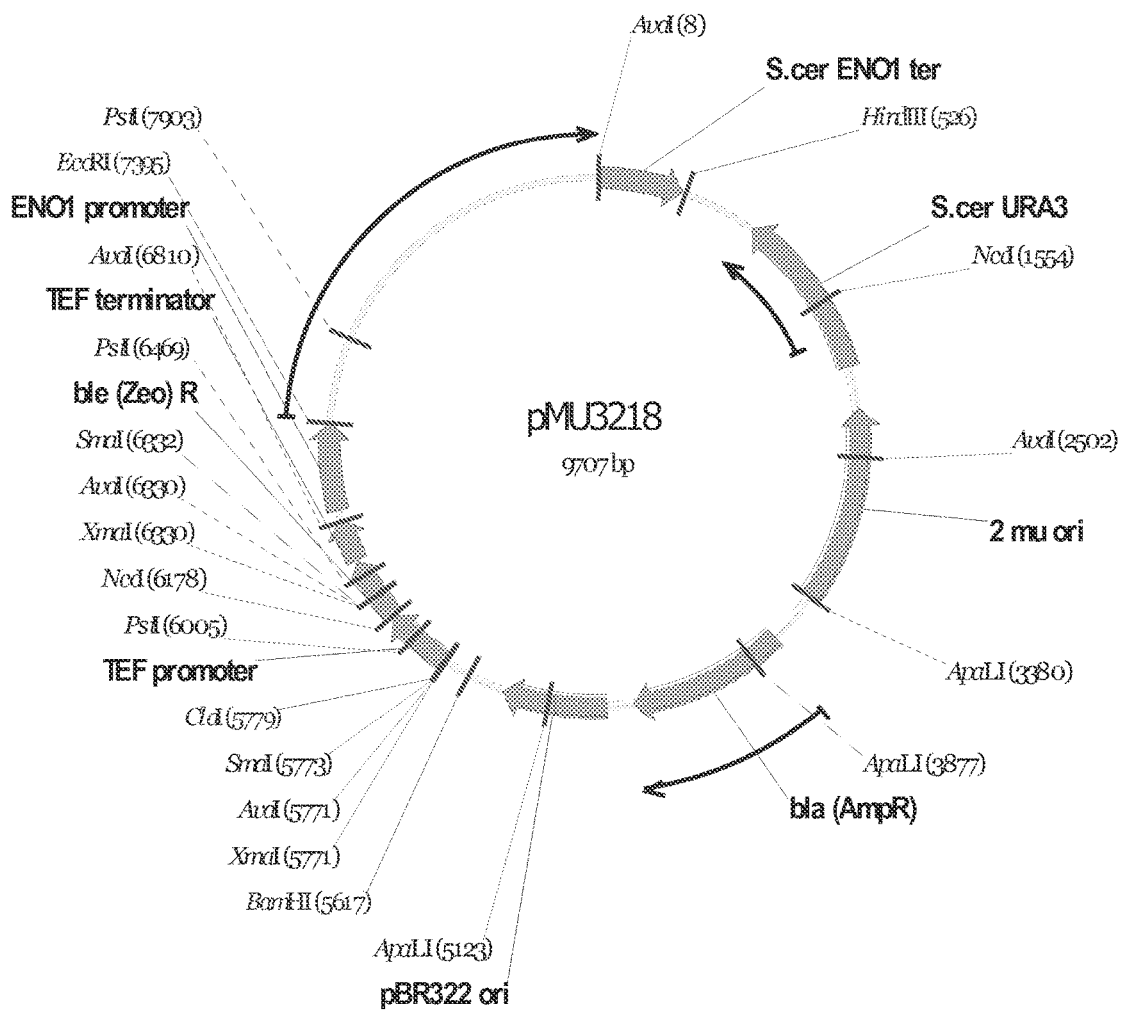
FIG. 31 depicts a plasmid map for pMU3218.
Figure 32:
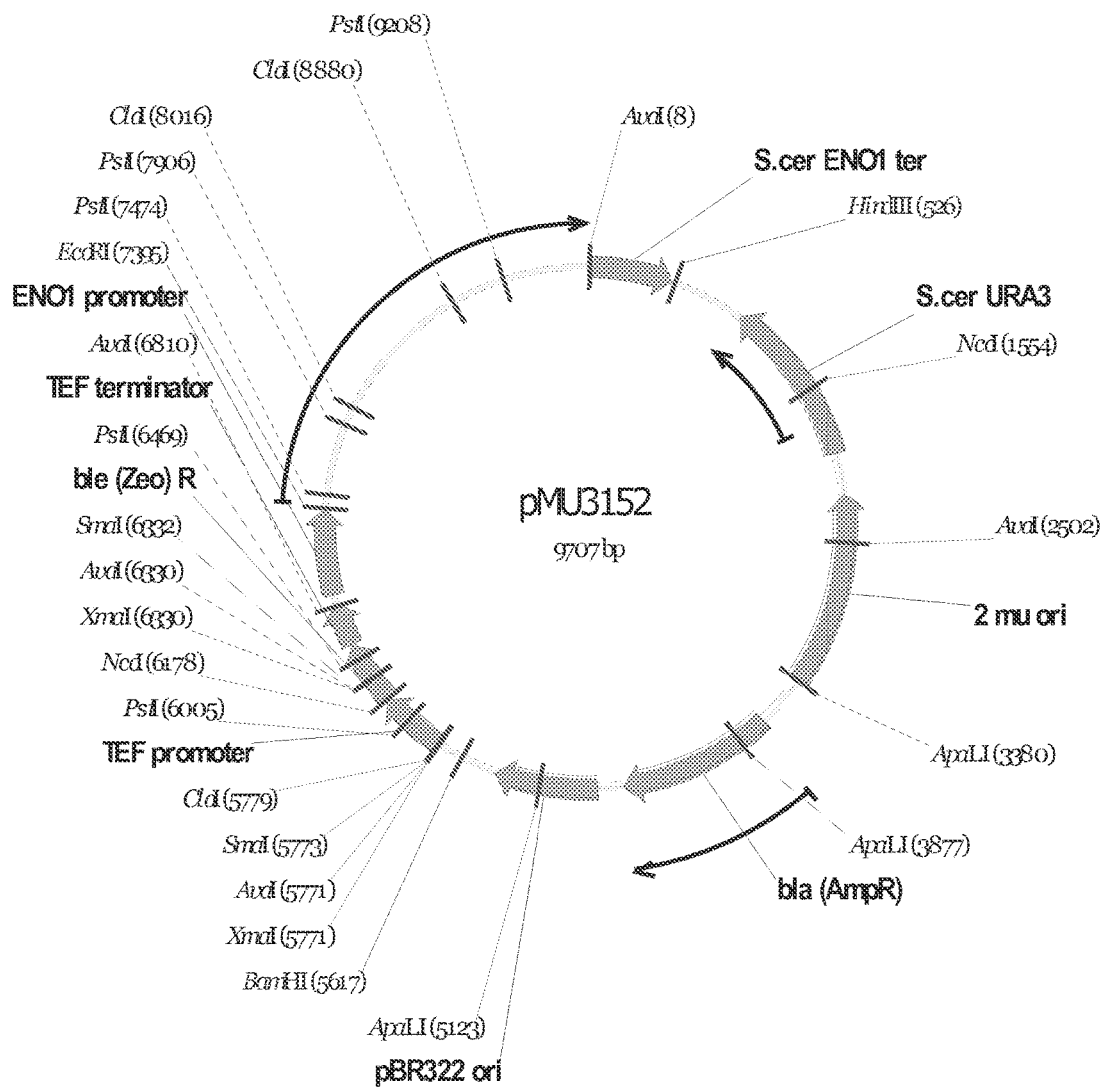
FIG. 32 depicts a plasmid map for pMU3152.
Figure 33:
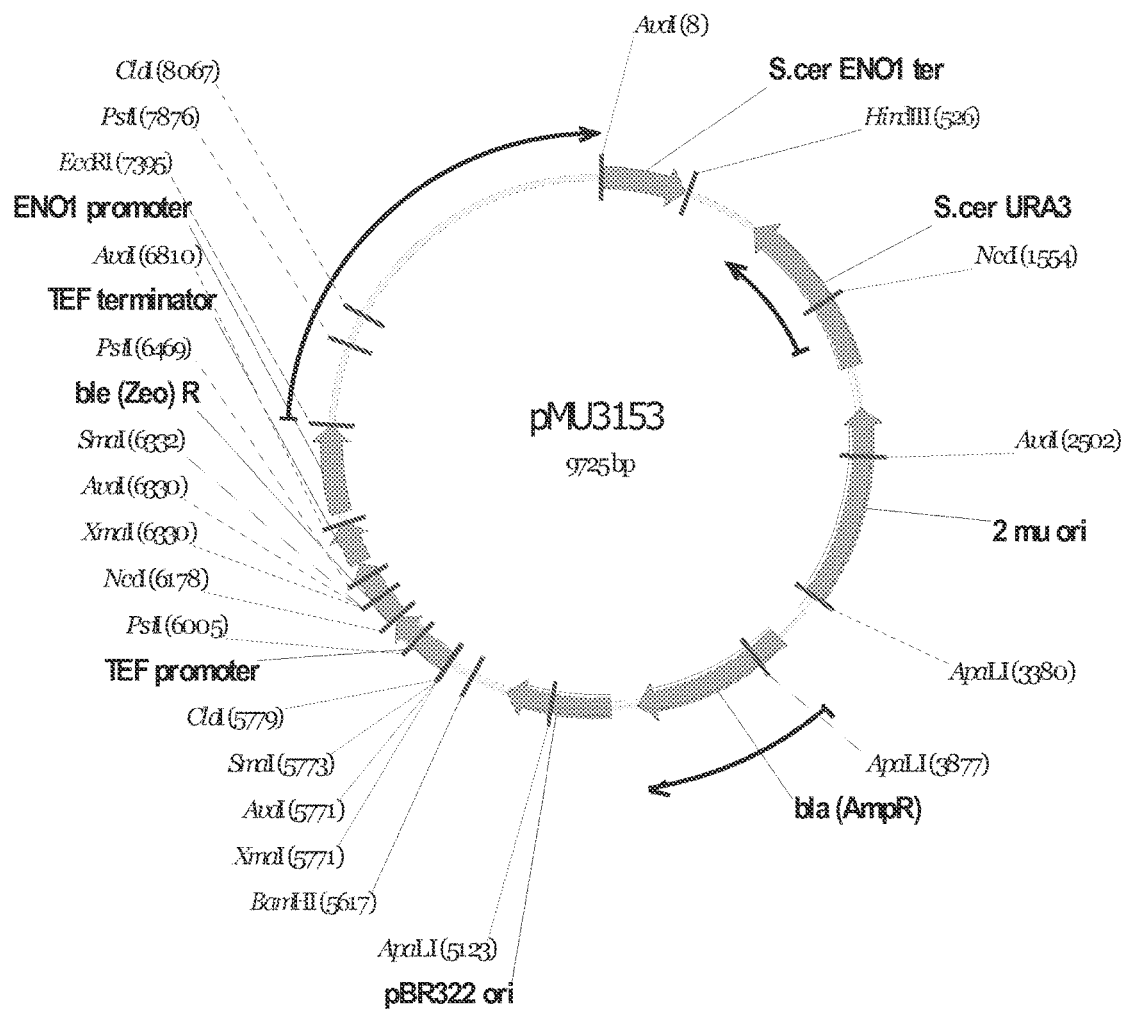
FIG. 33 depicts a plasmid map for pMU3153.
Figure 34:
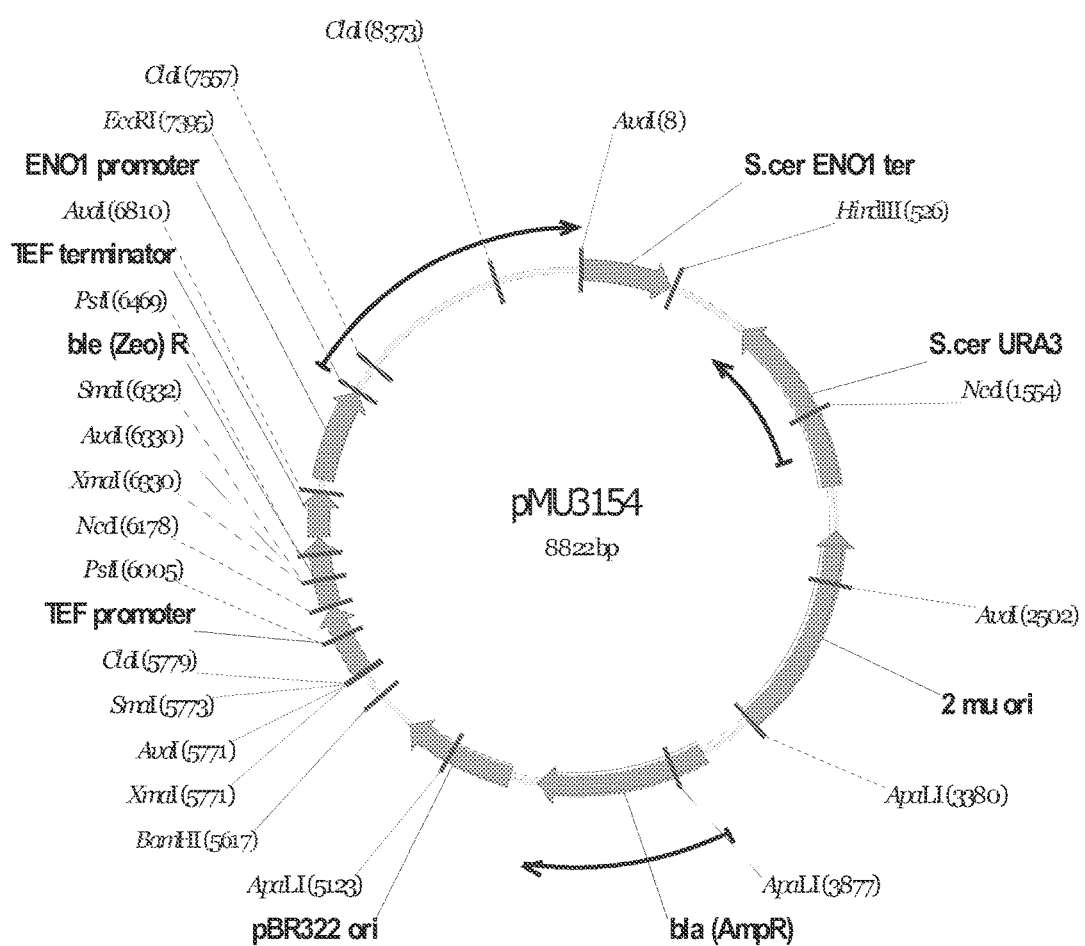
FIG. 34 depicts a plasmid map for pMU3154
Figure 35:
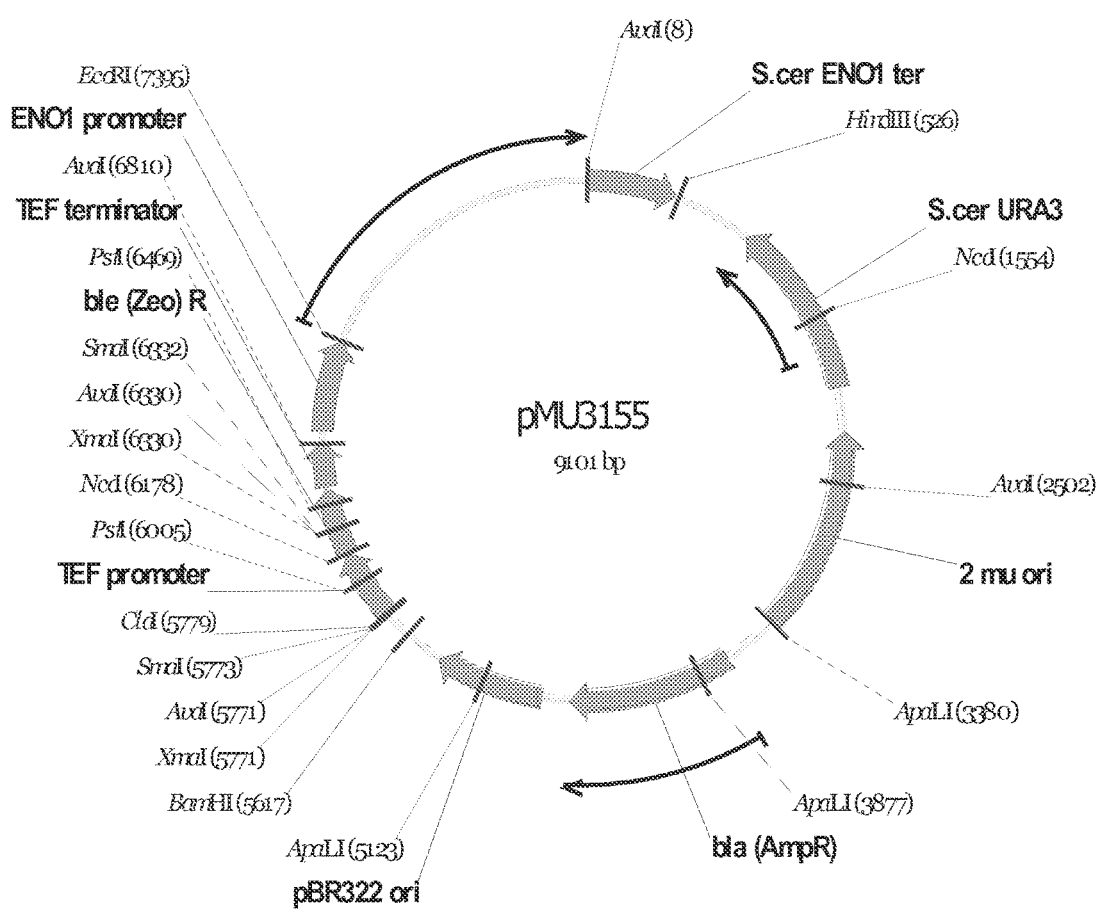
FIG. 35 depicts a plasmid map for pMU3155.
Figure 36:
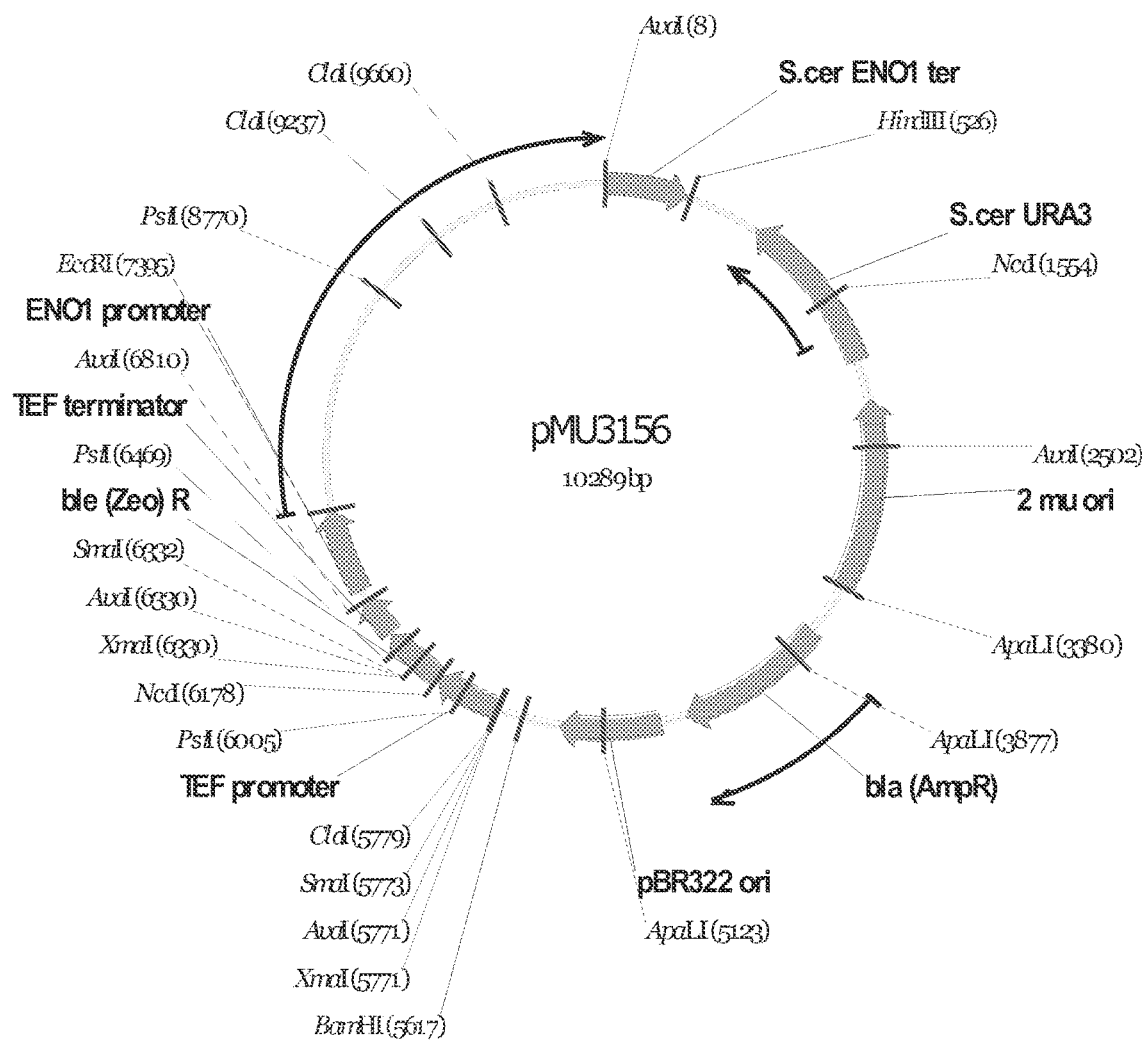
FIG. 36 depicts a plasmid map for pMU3156.
Figure 37:
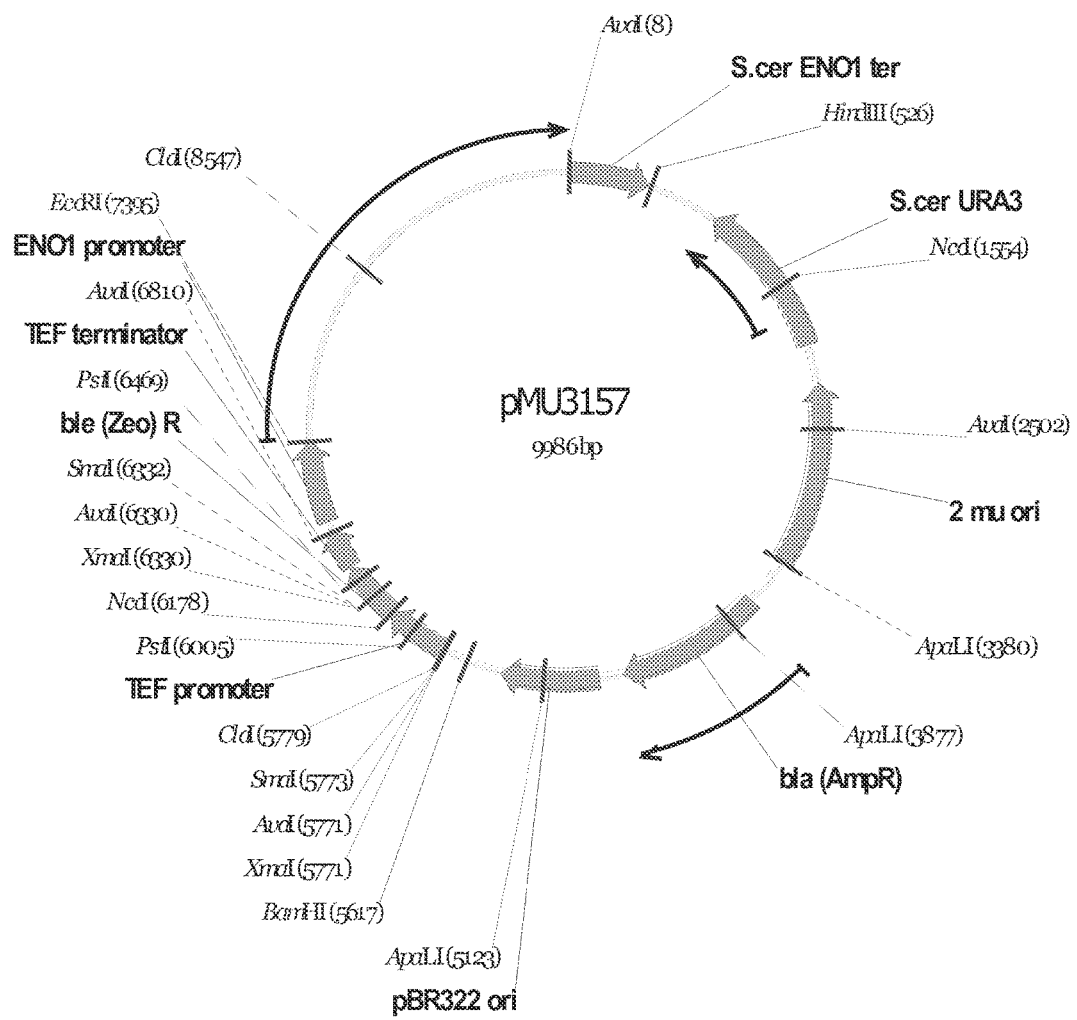
FIG. 37 depicts a plasmid map for pMU3157.
Figure 38:
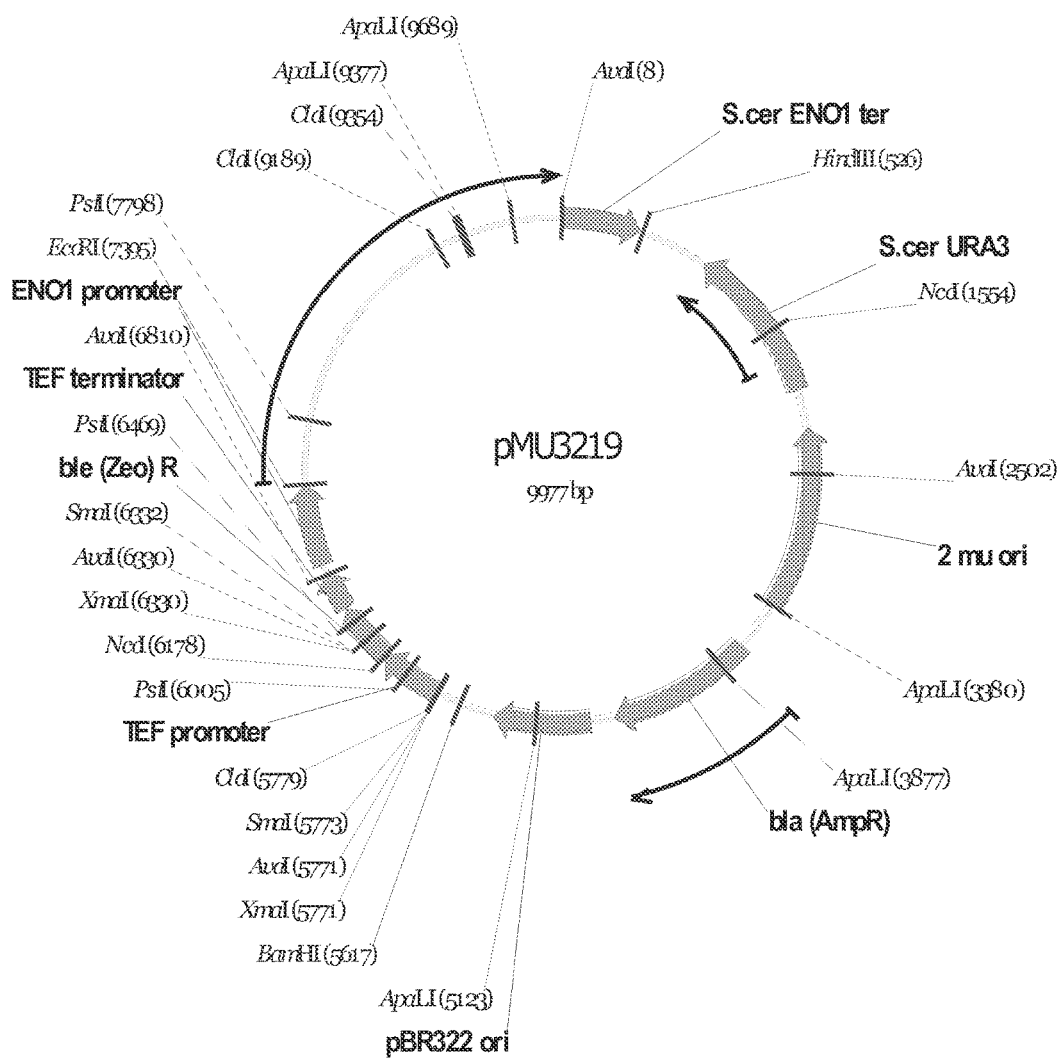
FIG. 38 depicts a plasmid map for pMU3219.
Figure 39:
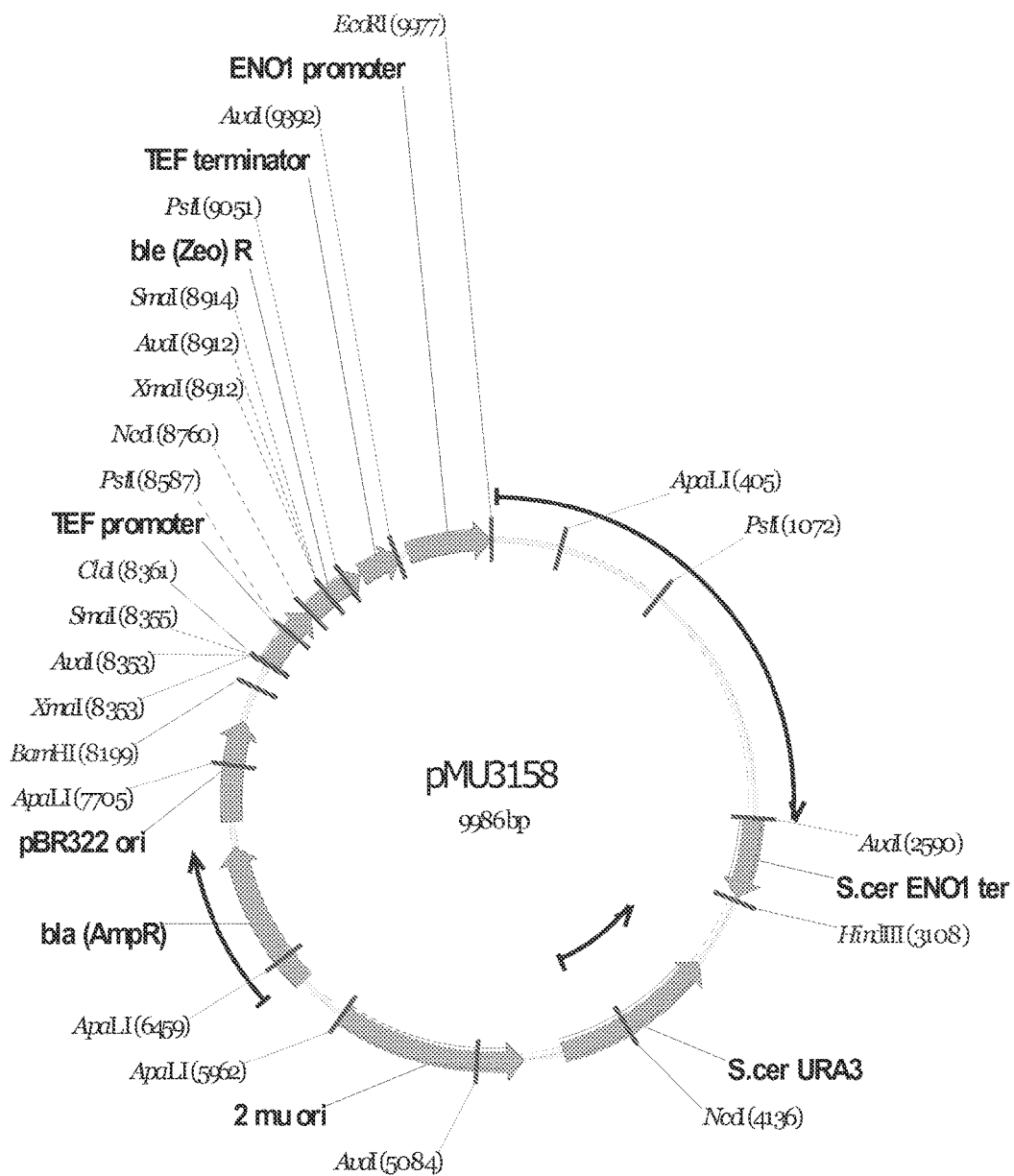
FIG. 39 depicts a plasmid map for pMU3158.
Figure 40:
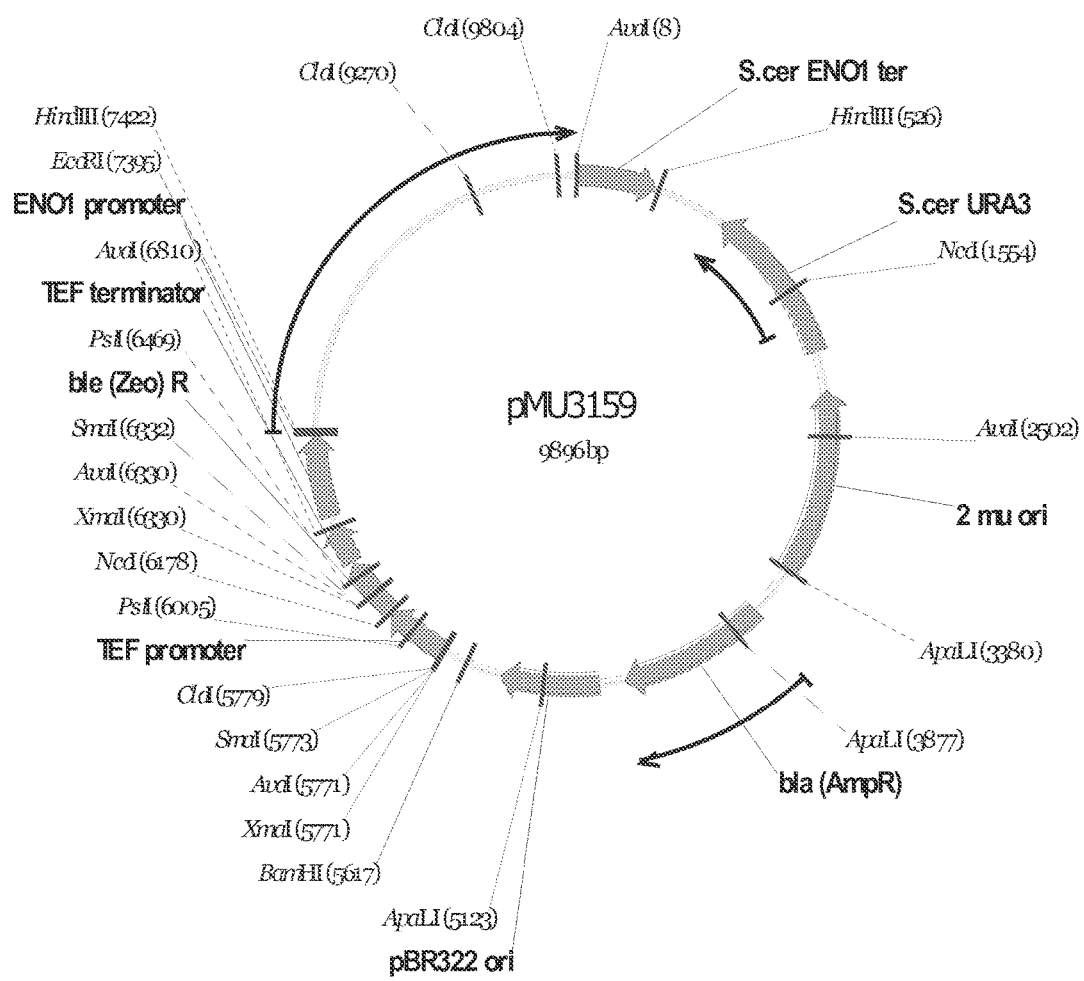
FIG. 40 depicts a plasmid map for pMU3159.
Figure 41:
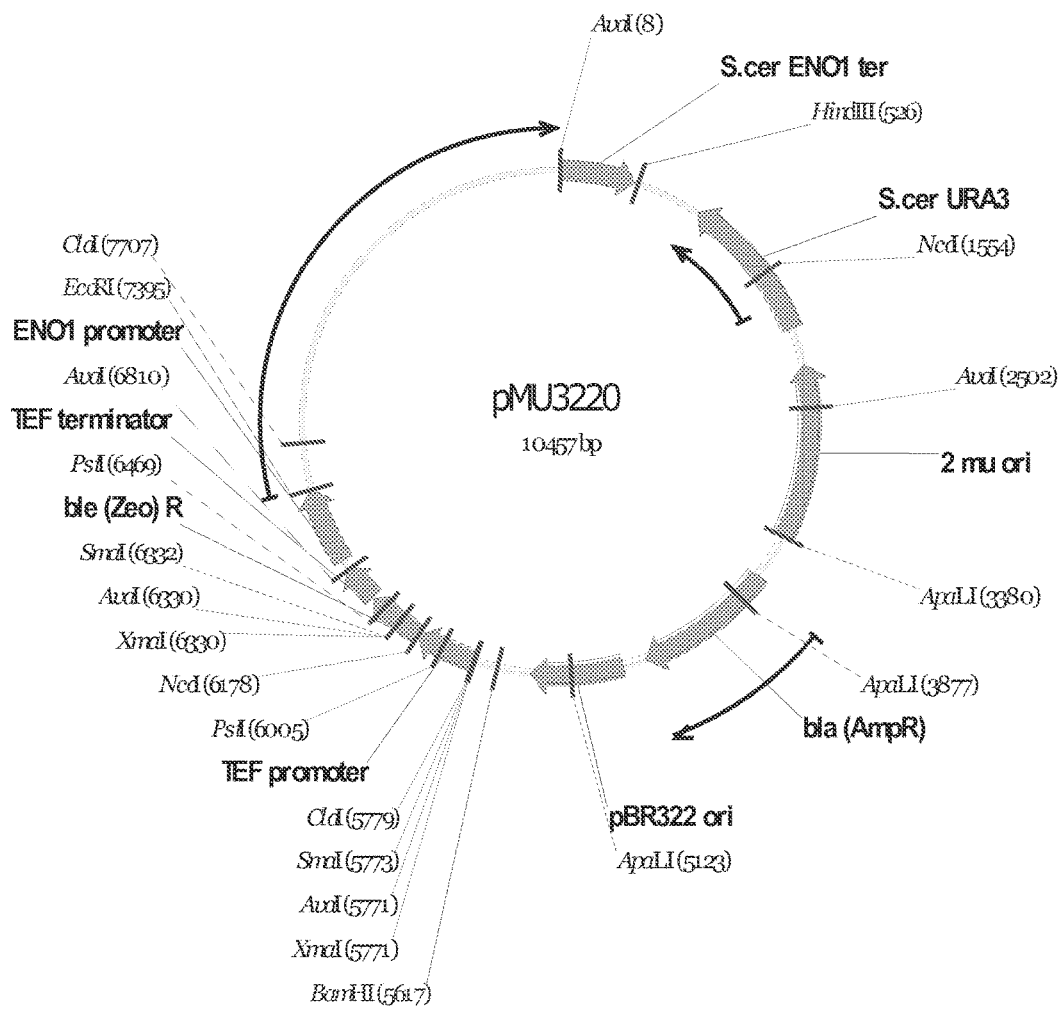
FIG. 41 depicts a plasmid map for pMU3220.
Figure 42:
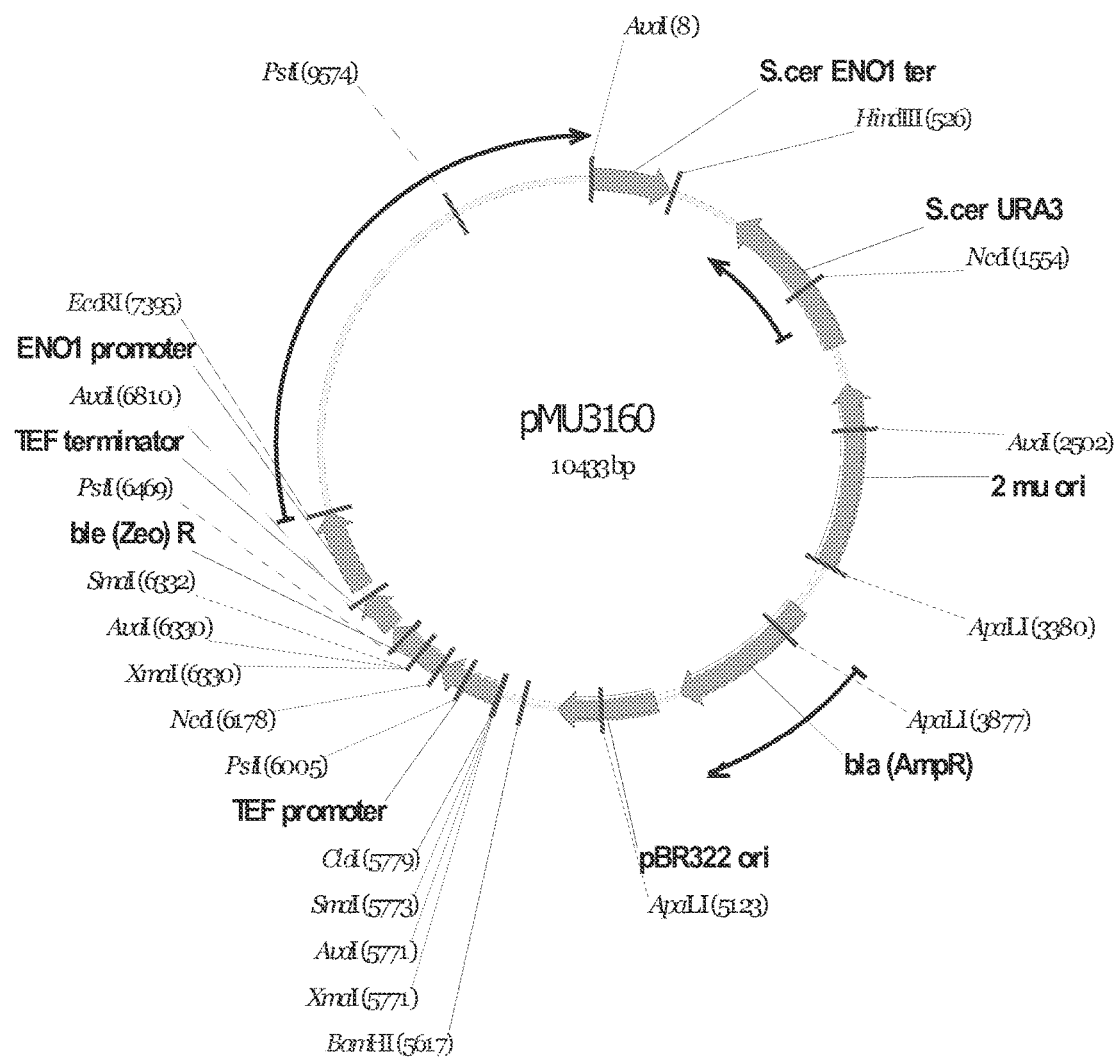
FIG. 42 depicts a plasmid map for pMU3160.
Figure 43:
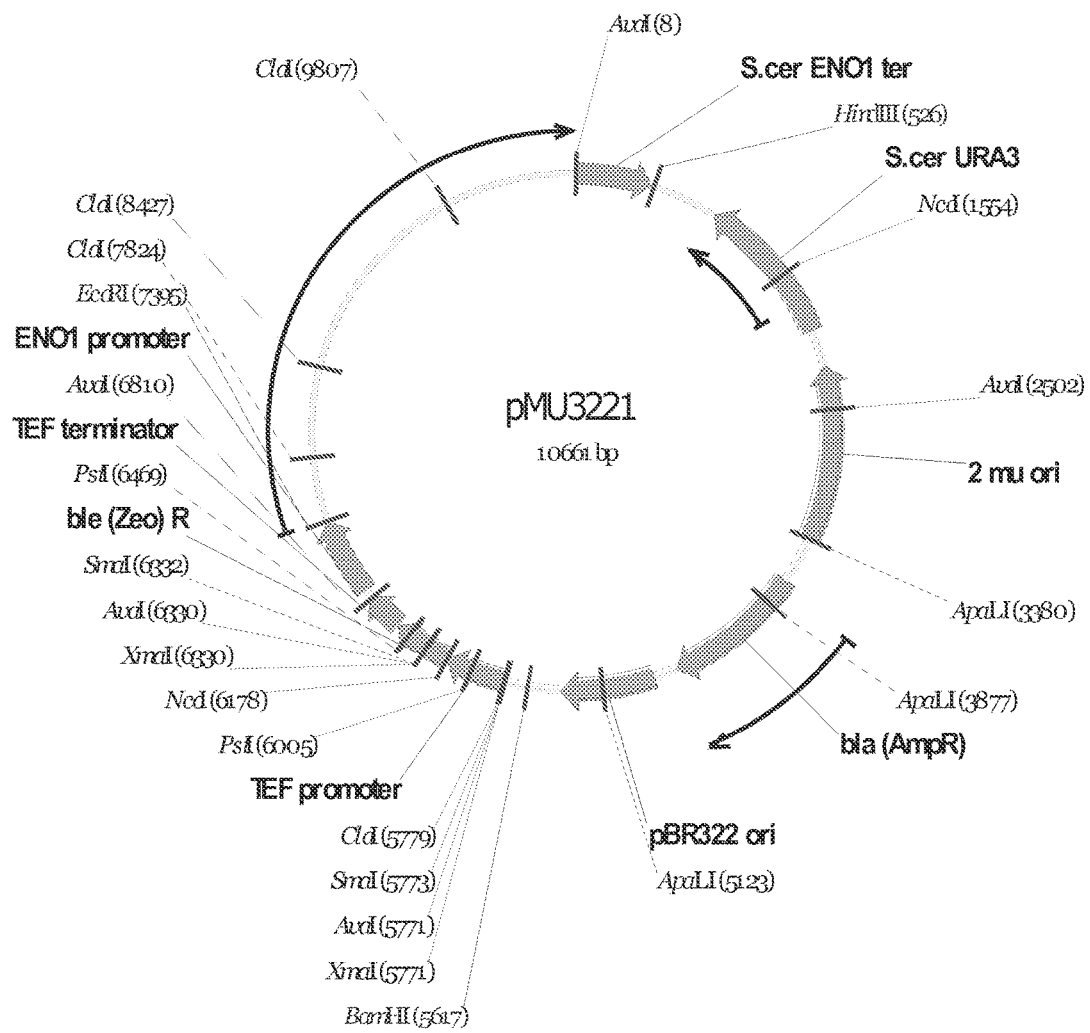
FIG. 43 depicts a plasmid map for pMU3221.
Figure 44:
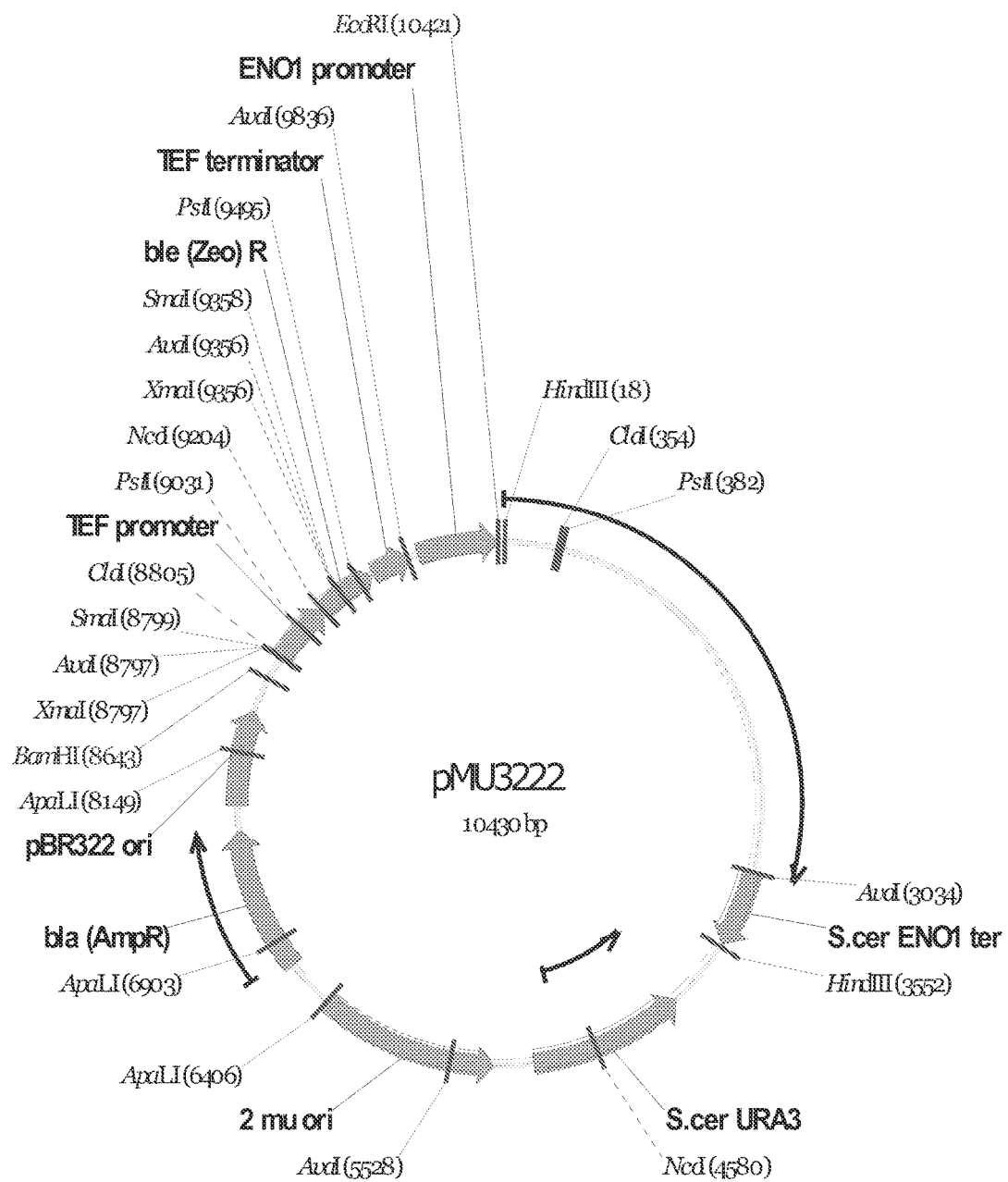
FIG. 44 depicts a plasmid map for pMU3222.
Figure 45:
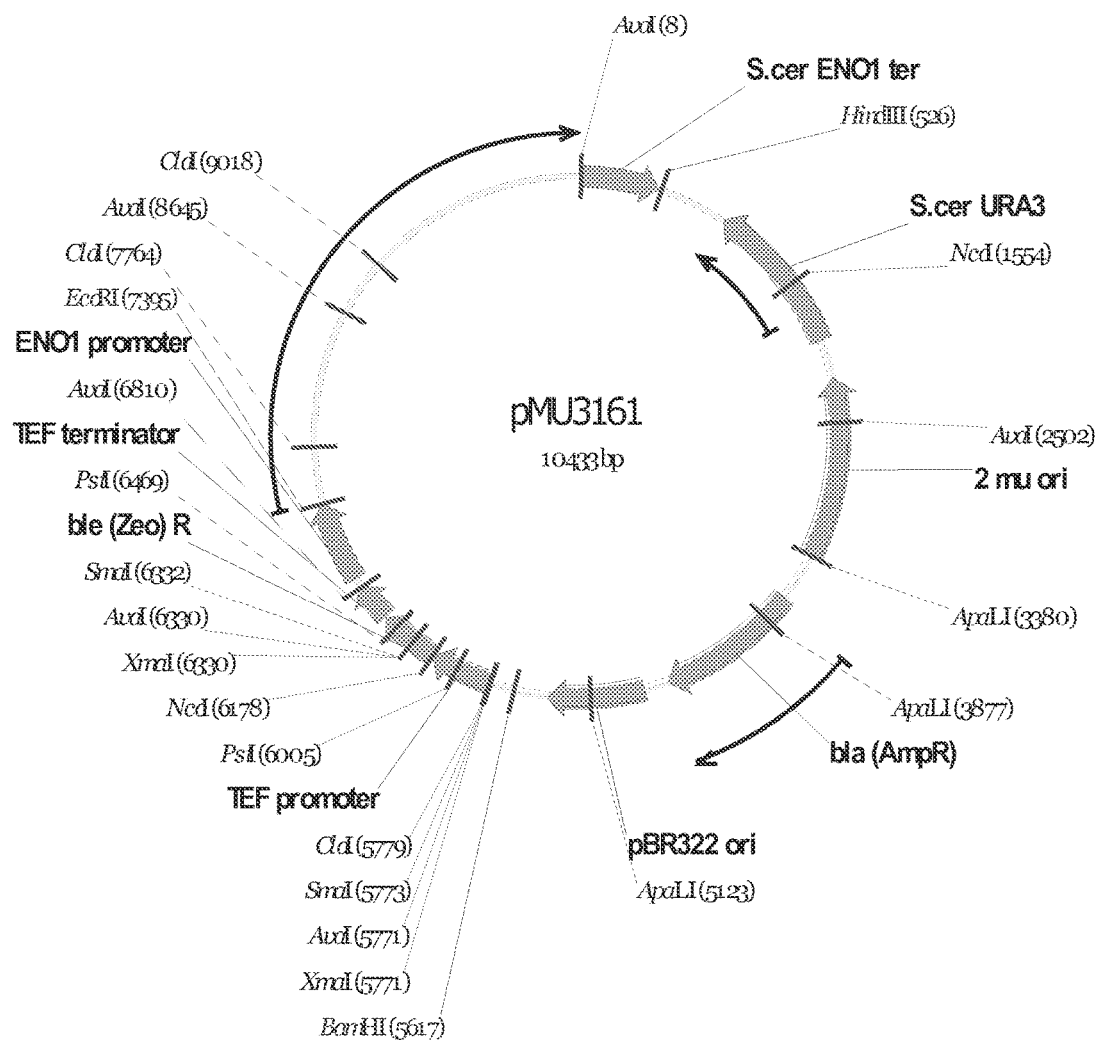
FIG. 45 depicts a plasmid map for pMU3161.
Figure 46:
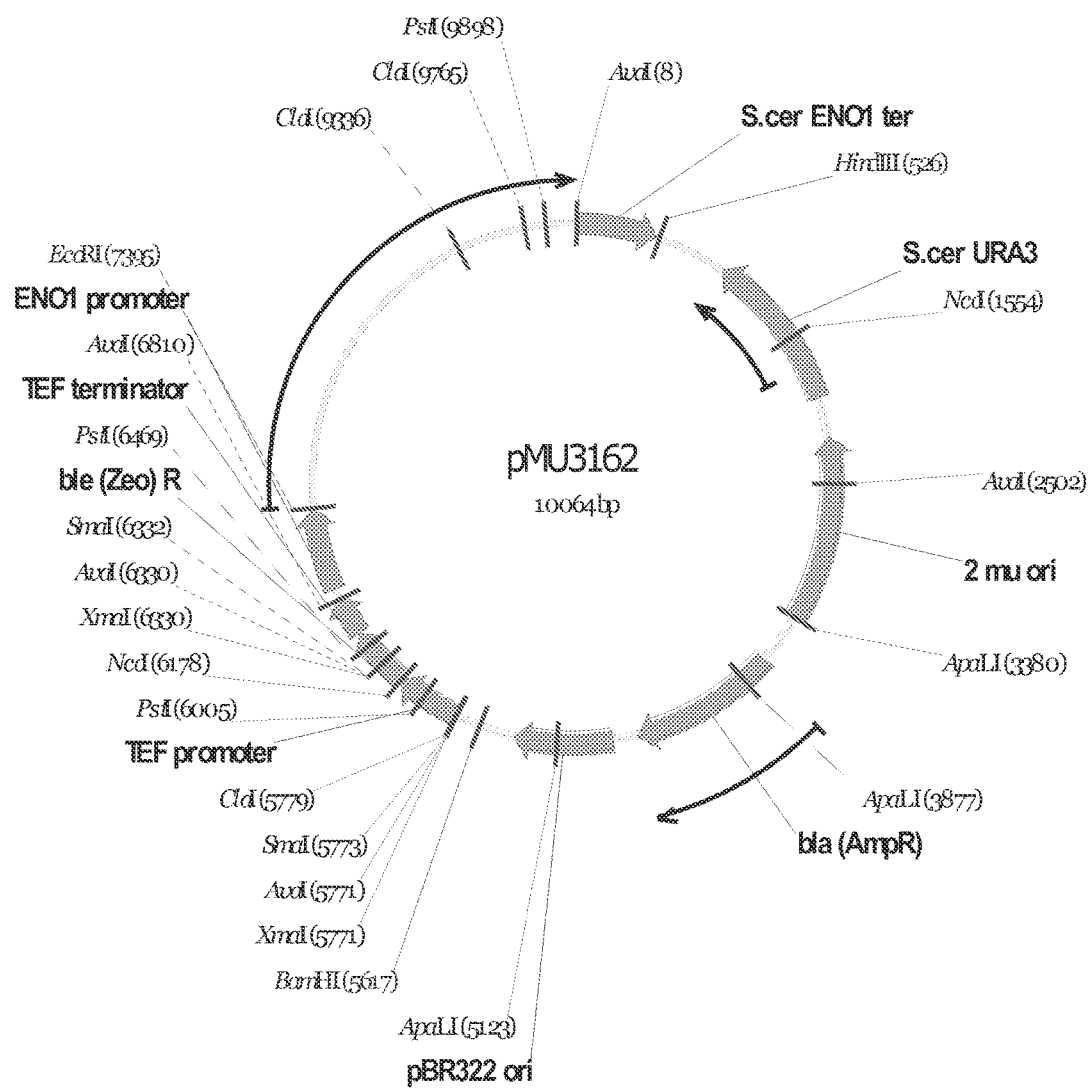
FIG. 46 depicts a plasmid map for pMU3162.
Figure 47:
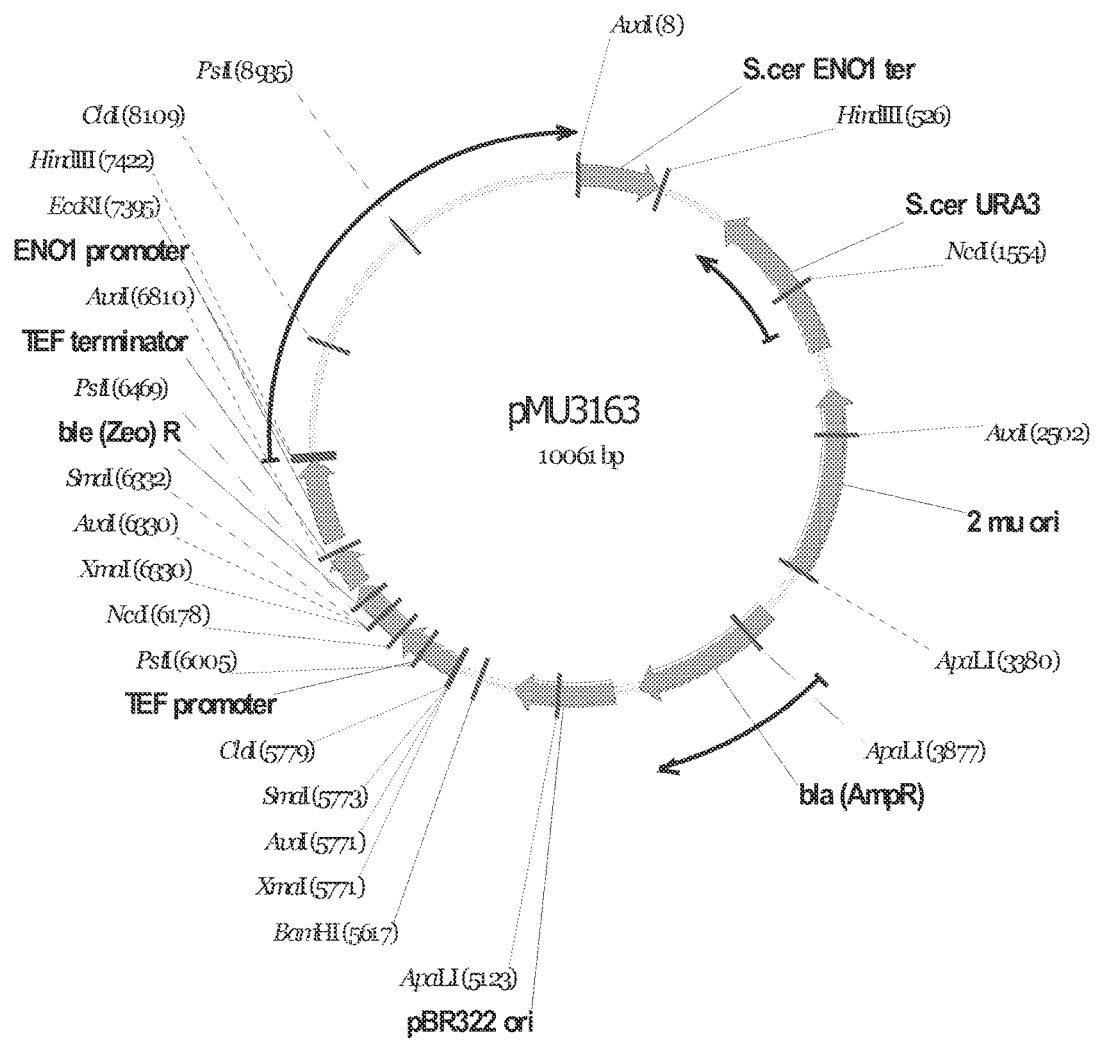
FIG. 47 depicts a plasmid map for pMU3163.
Figure 48:
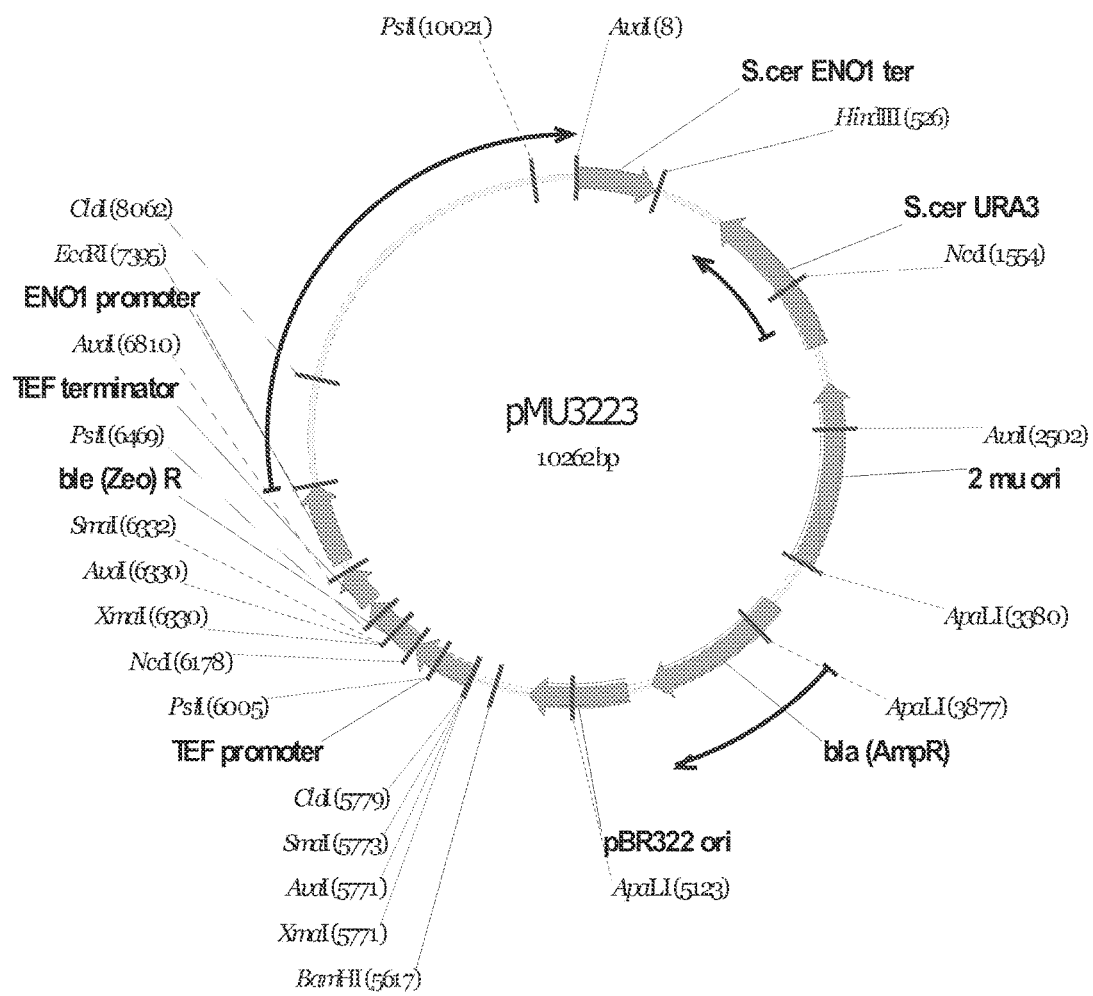
FIG. 48 depicts a plasmid map for pMU3223.
Figure 49:
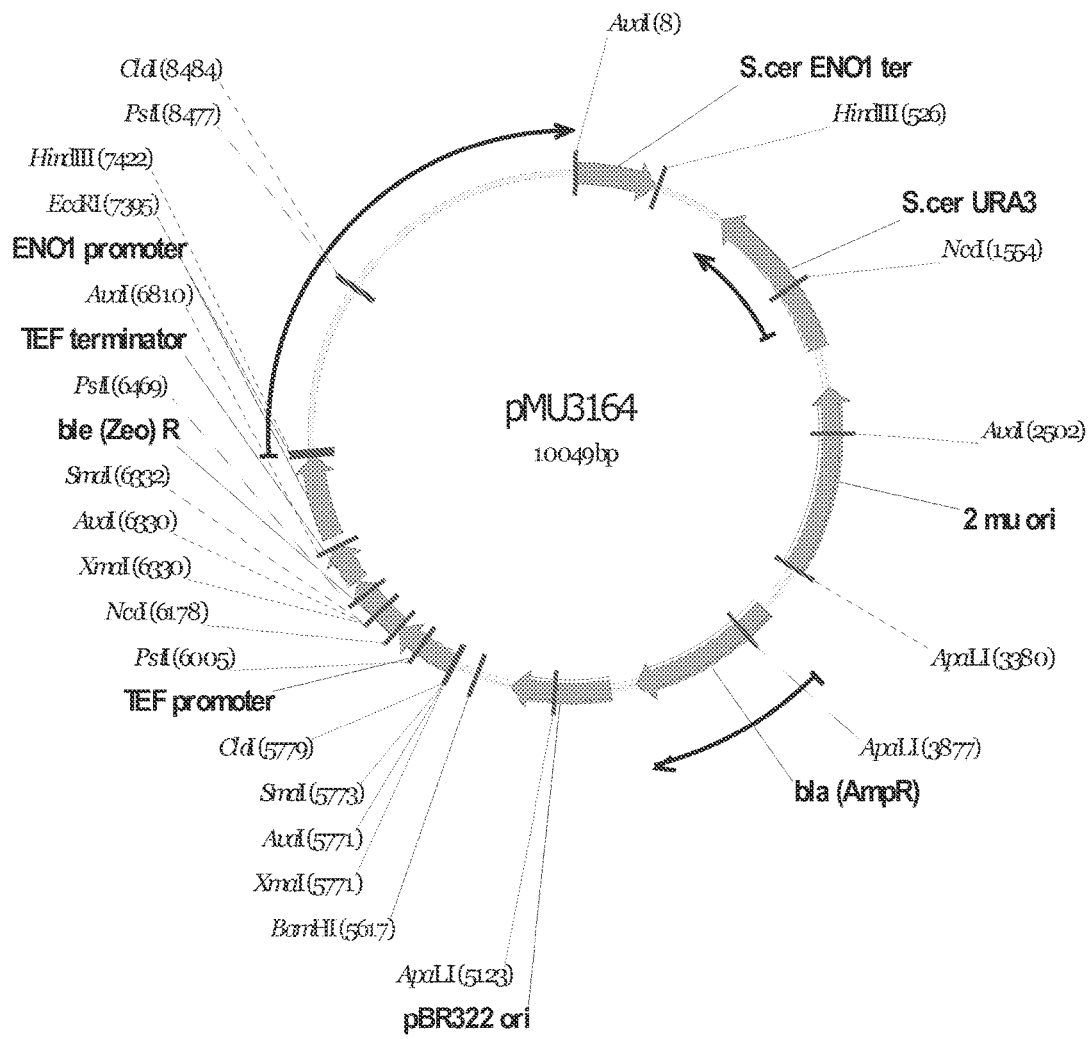
FIG. 49 depicts a plasmid map for pMU3164.
Figure 50:
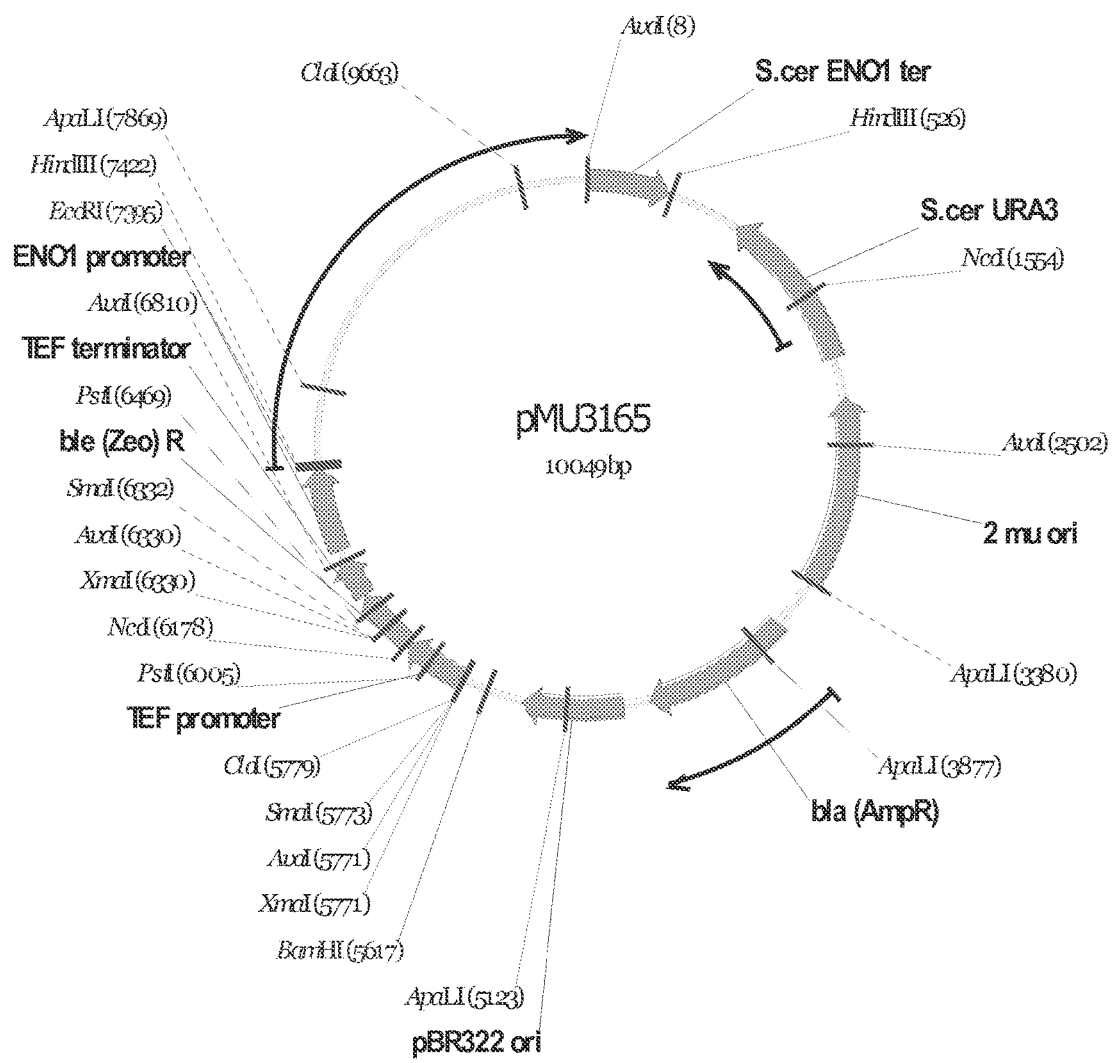
FIG. 50 depicts a plasmid map for pMU3165.
Figure 51:
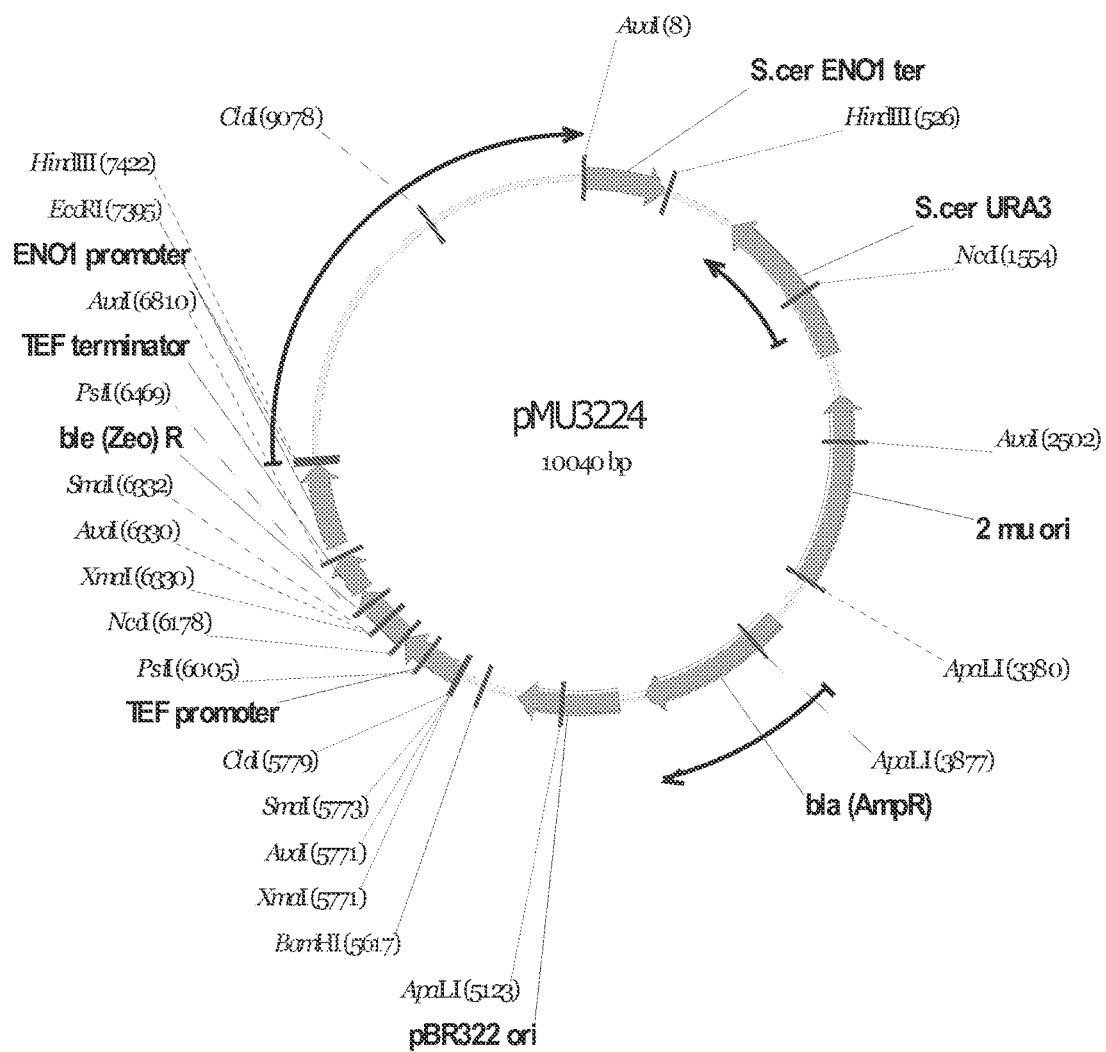
FIG. 51 depicts a plasmid map for pMU3224.
Figure 52:
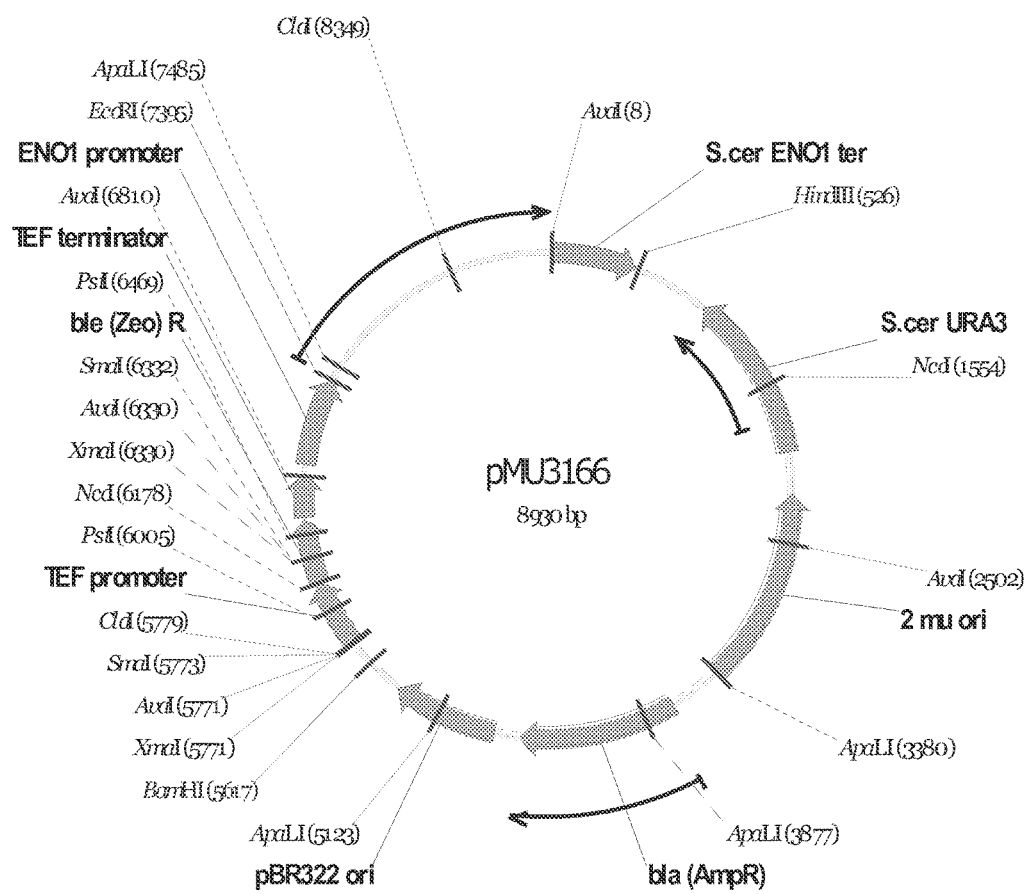
FIG. 52 depicts a plasmid map for pMU3166.
Figure 53:
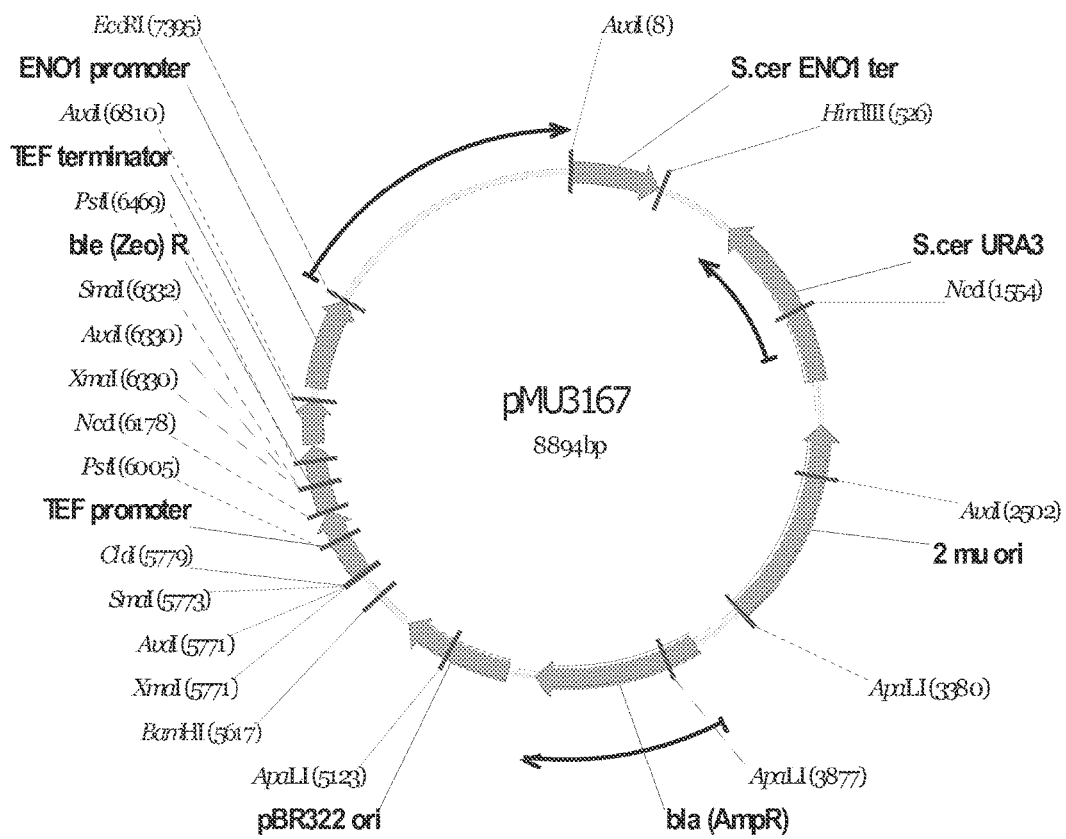
FIG. 53 depicts a plasmid map for pMU3167.
Figure 54:
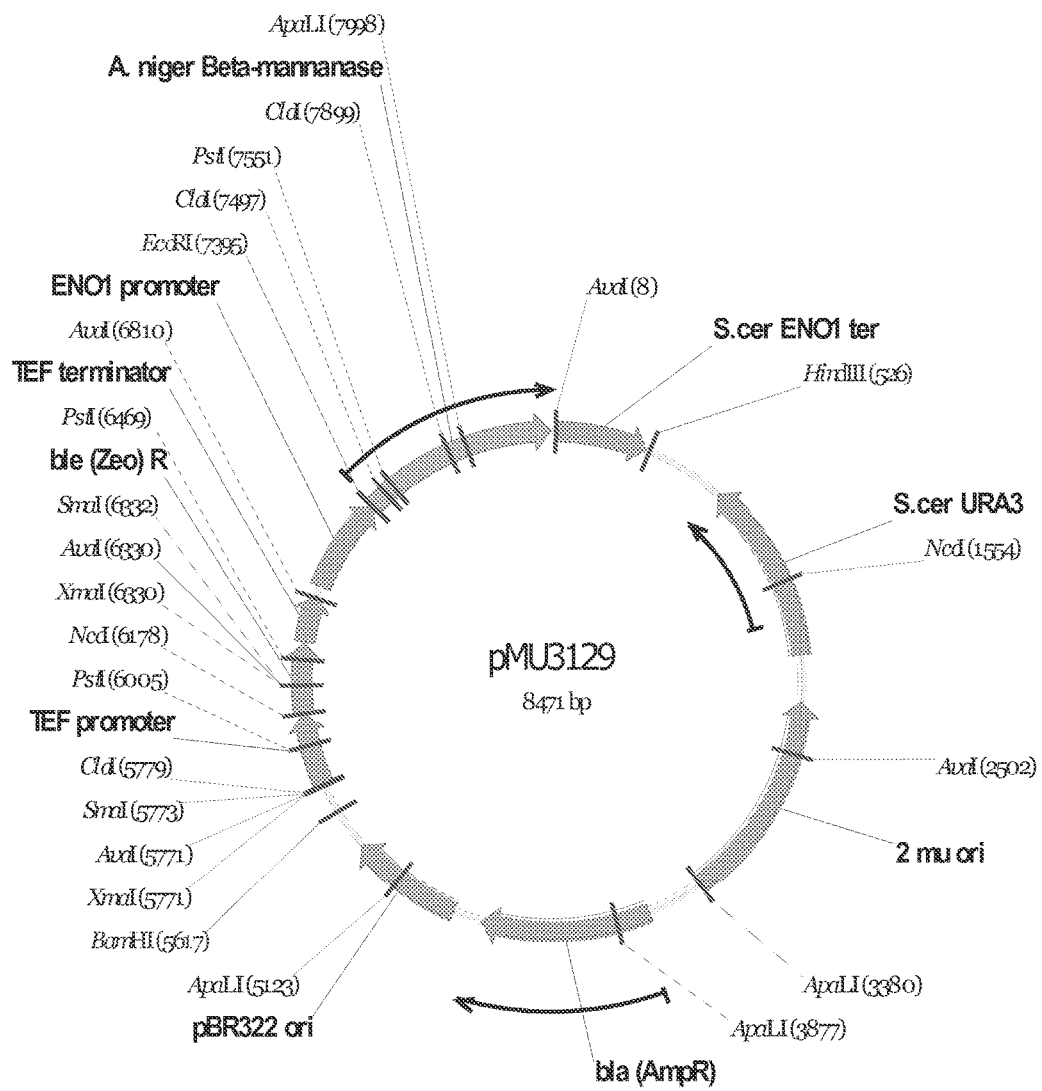
FIG. 54 depicts a plasmid map for pMU3129.
Figure 55:
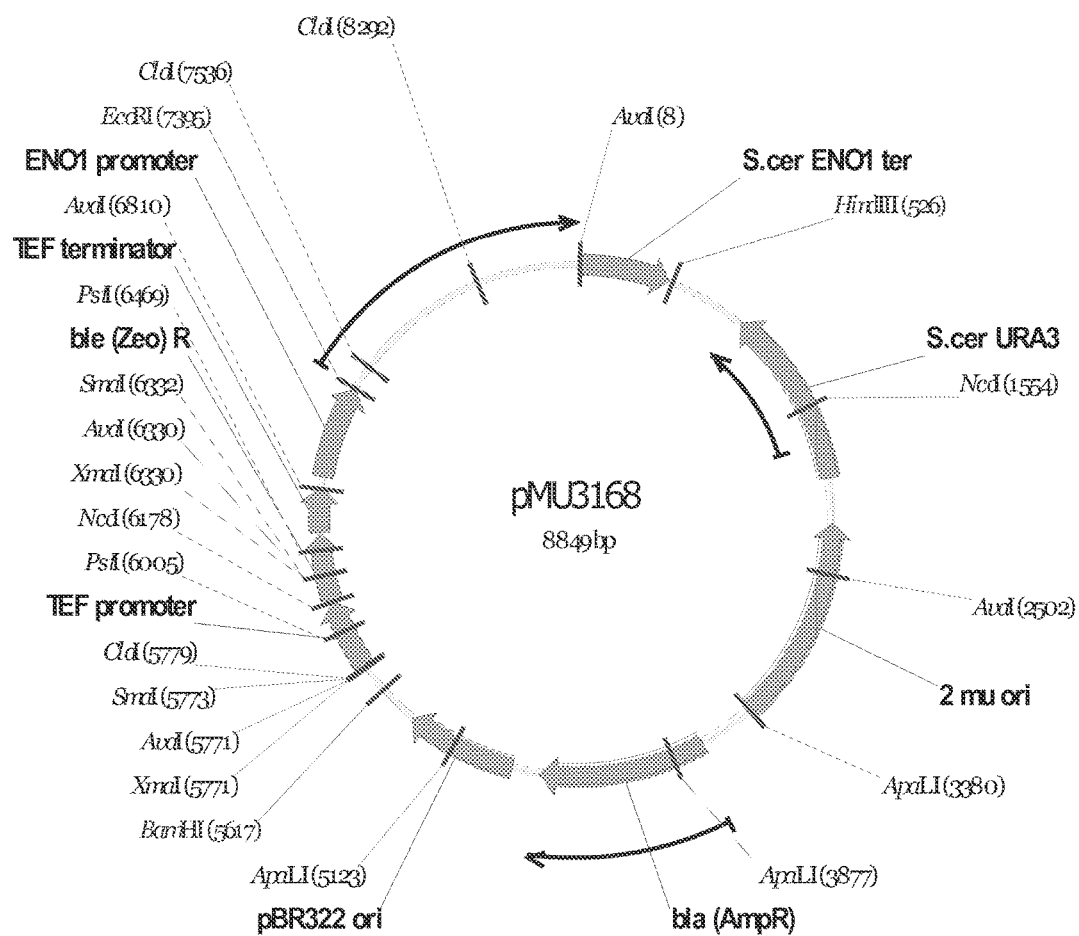
FIG. 55 depicts a plasmid map for pMU3168.
Figure 56:
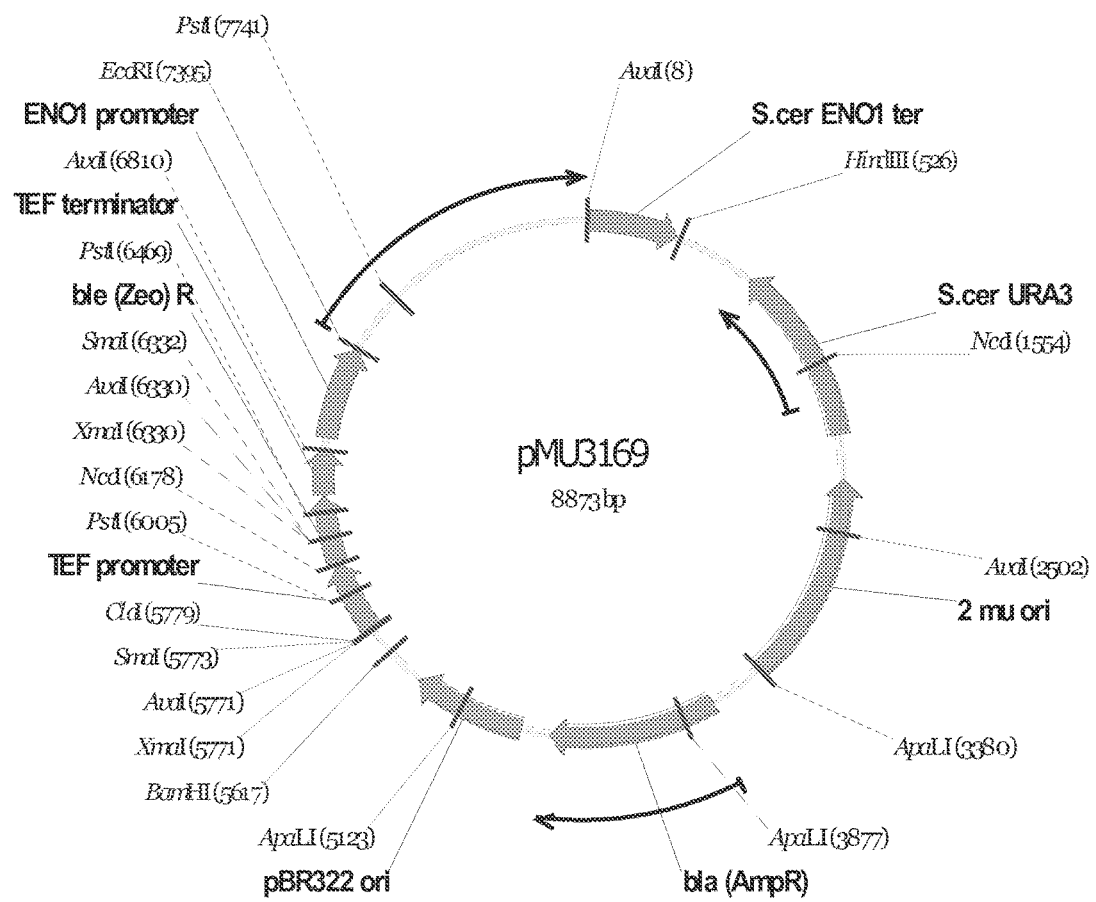
FIG. 56 depicts a plasmid map for pMU3169.
Figure 57:
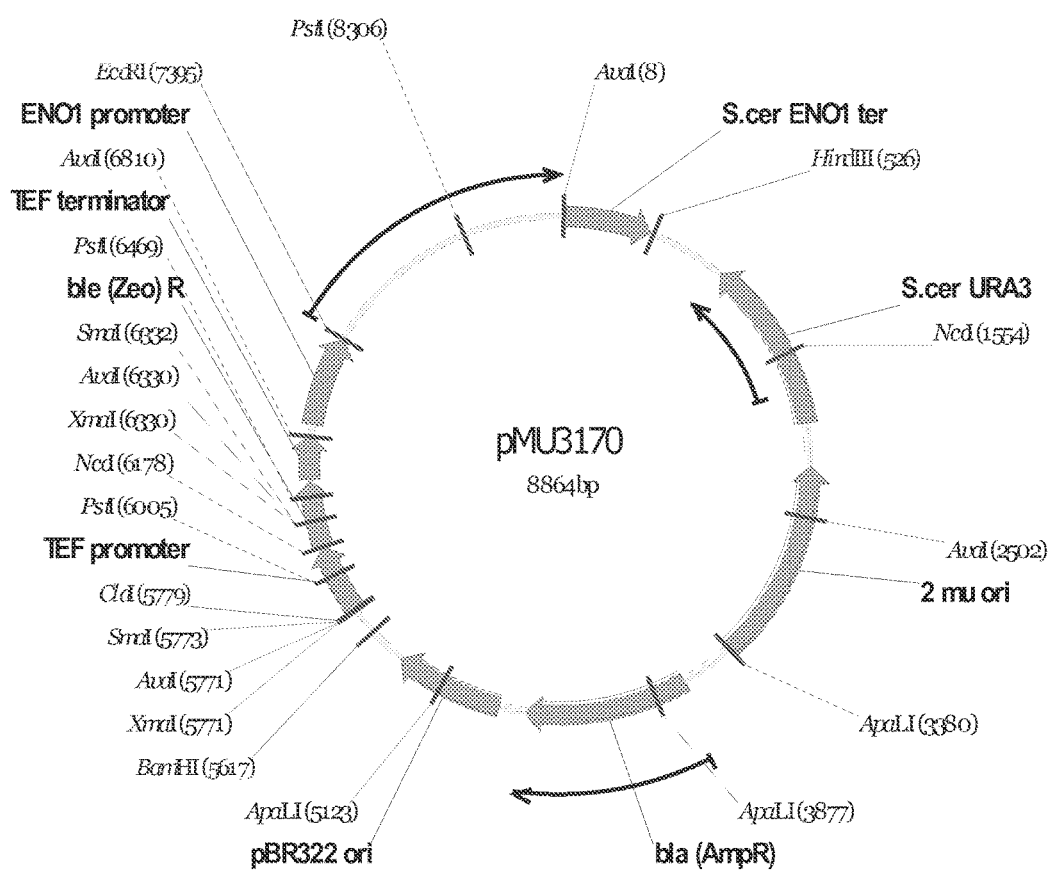
FIG. 57 depicts a plasmid map for pMU3170.
Figure 58:
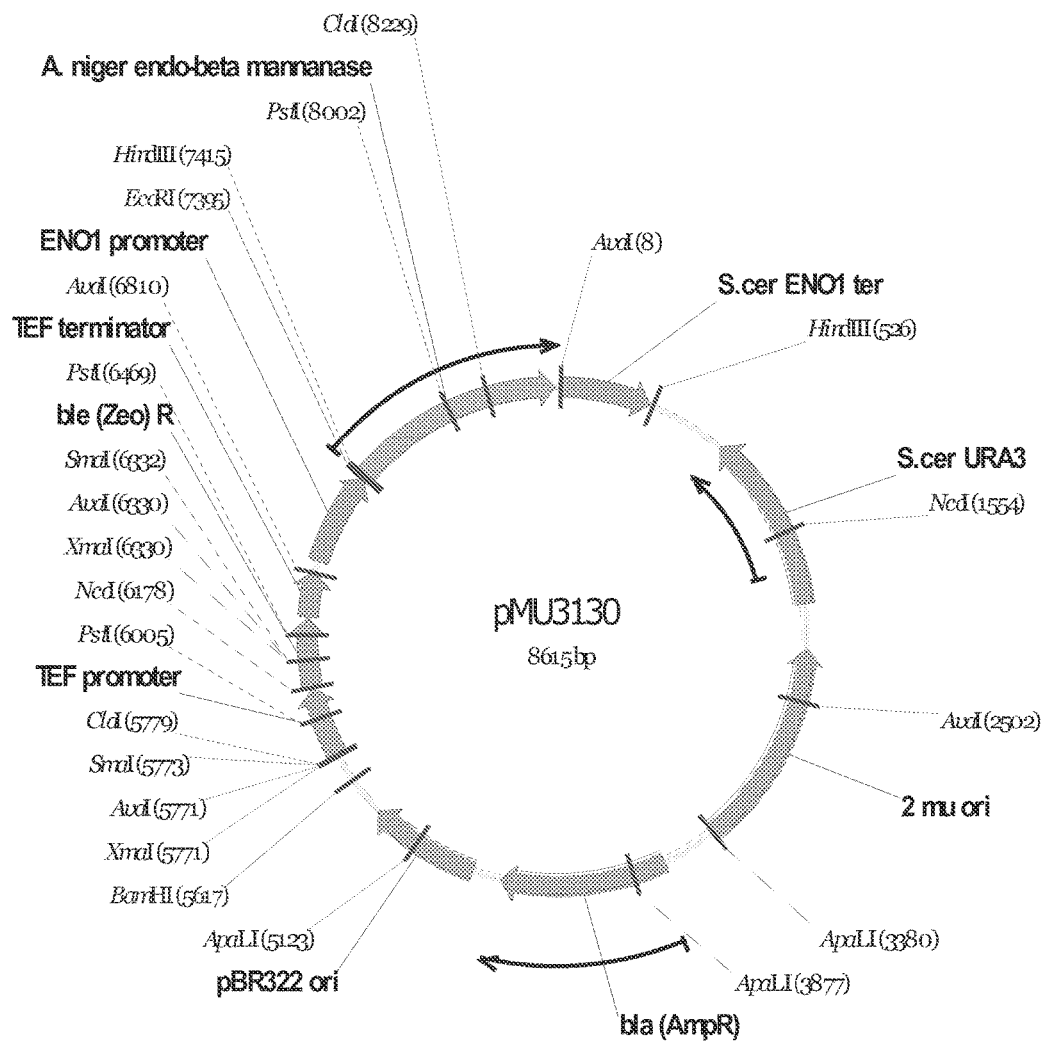
FIG. 58 depicts a plasmid map for pMU3130.
Figure 59:
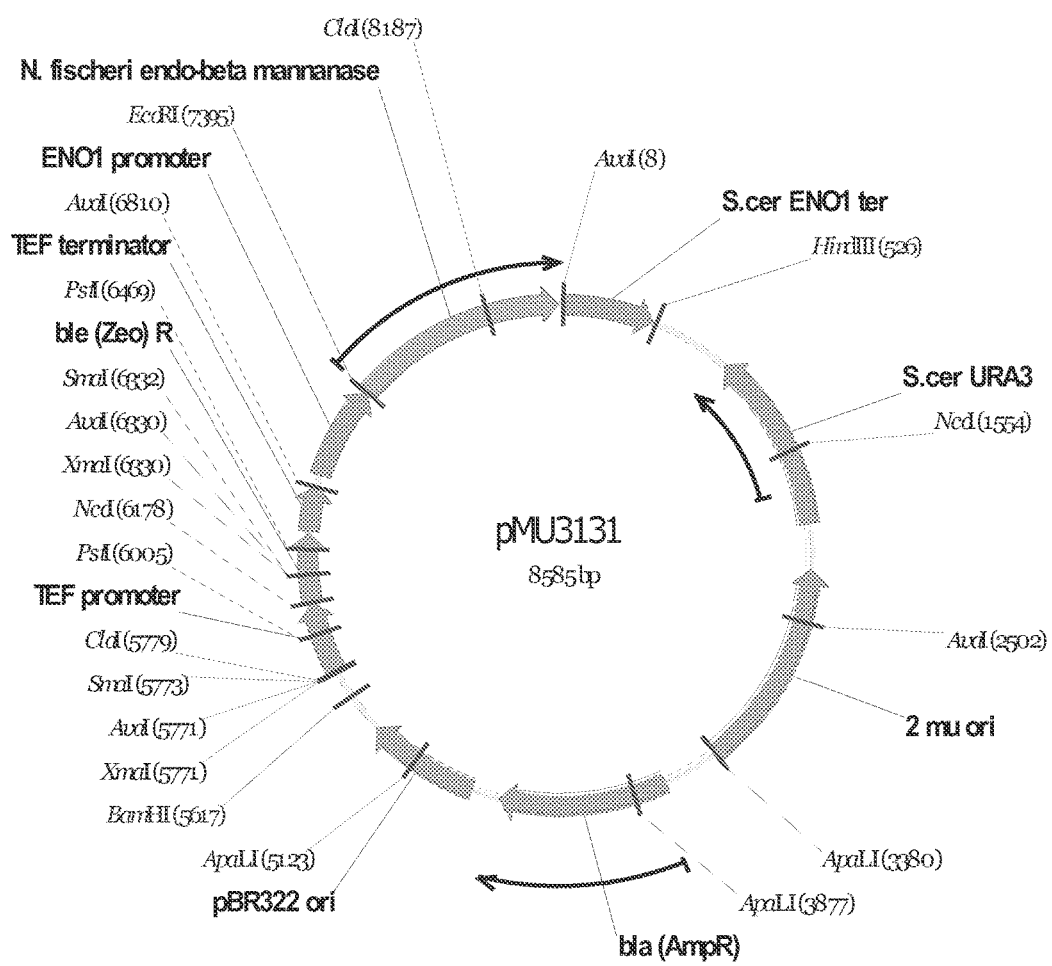
FIG. 59 depicts a plasmid map for pMU3131.
Figure 60:
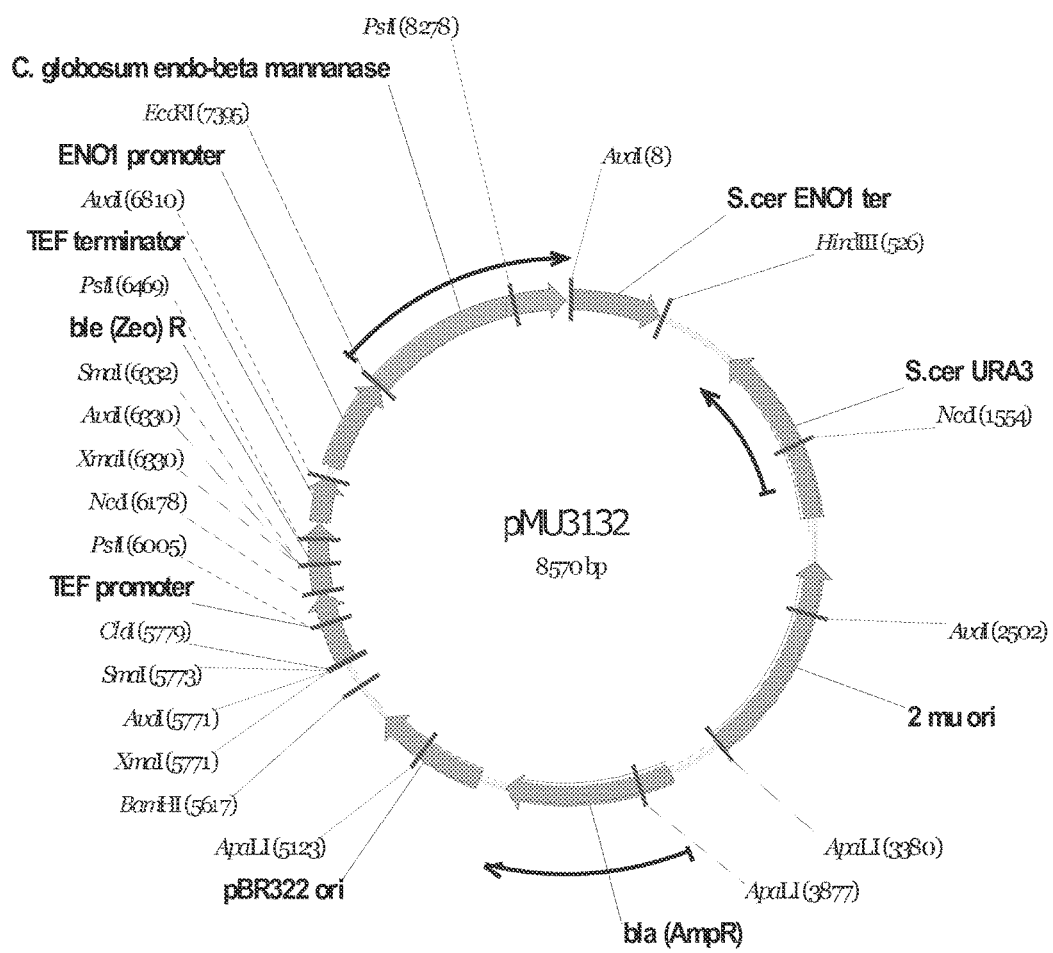
FIG. 60 depicts a plasmid map for pMU3132.
Figure 61:
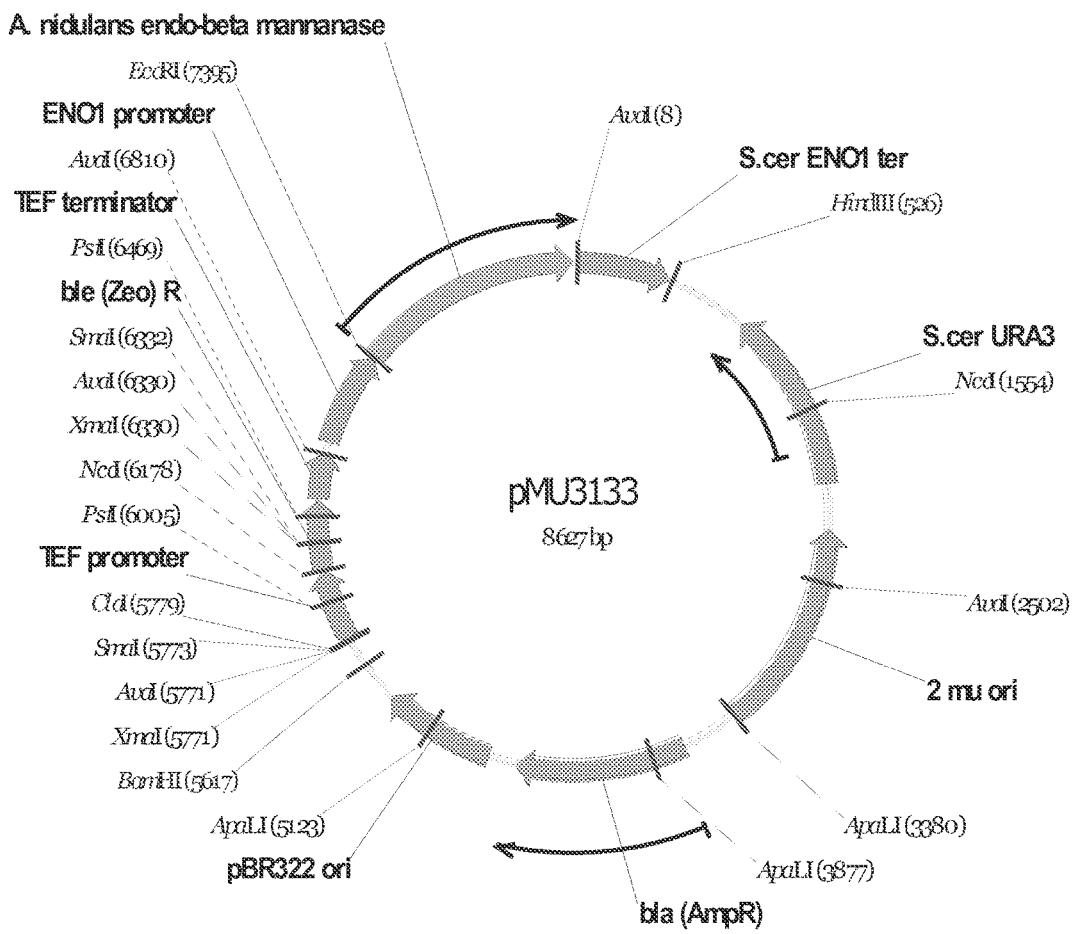
FIG. 61 depicts a plasmid map for pMU3133.
Figure 62:
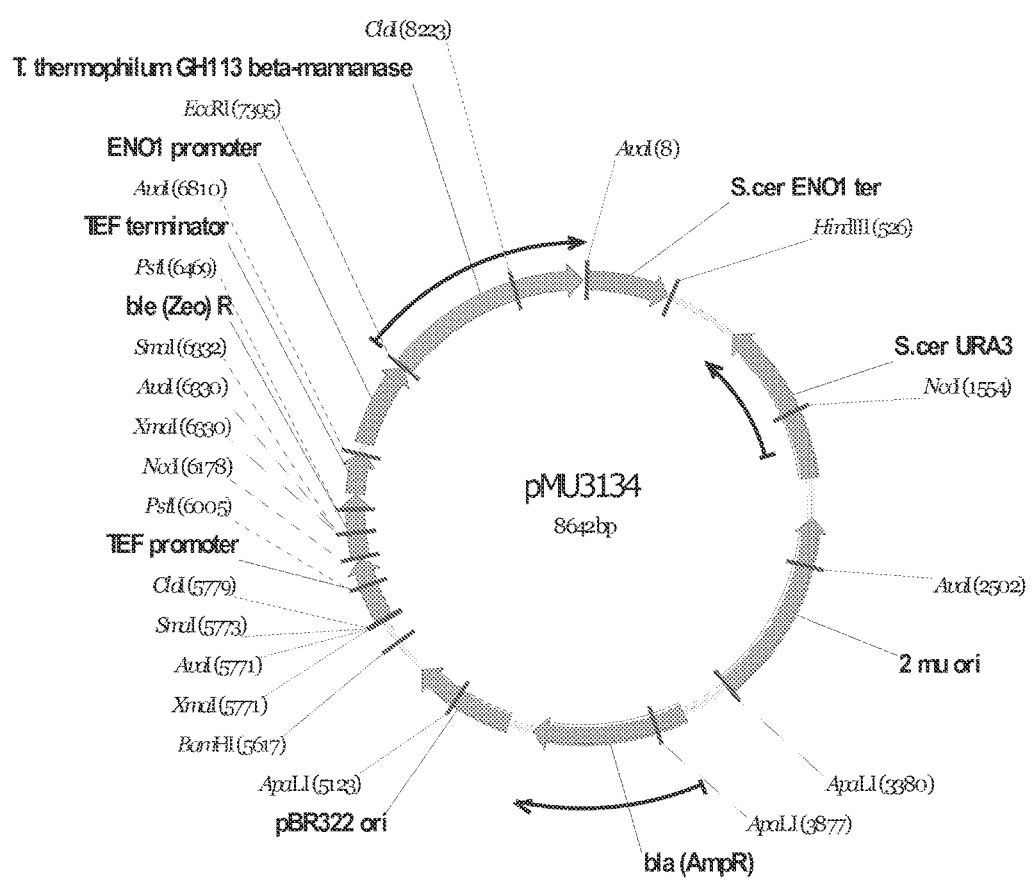
FIG. 62 depicts a plasmid map for pMU3134.
Figure 63:
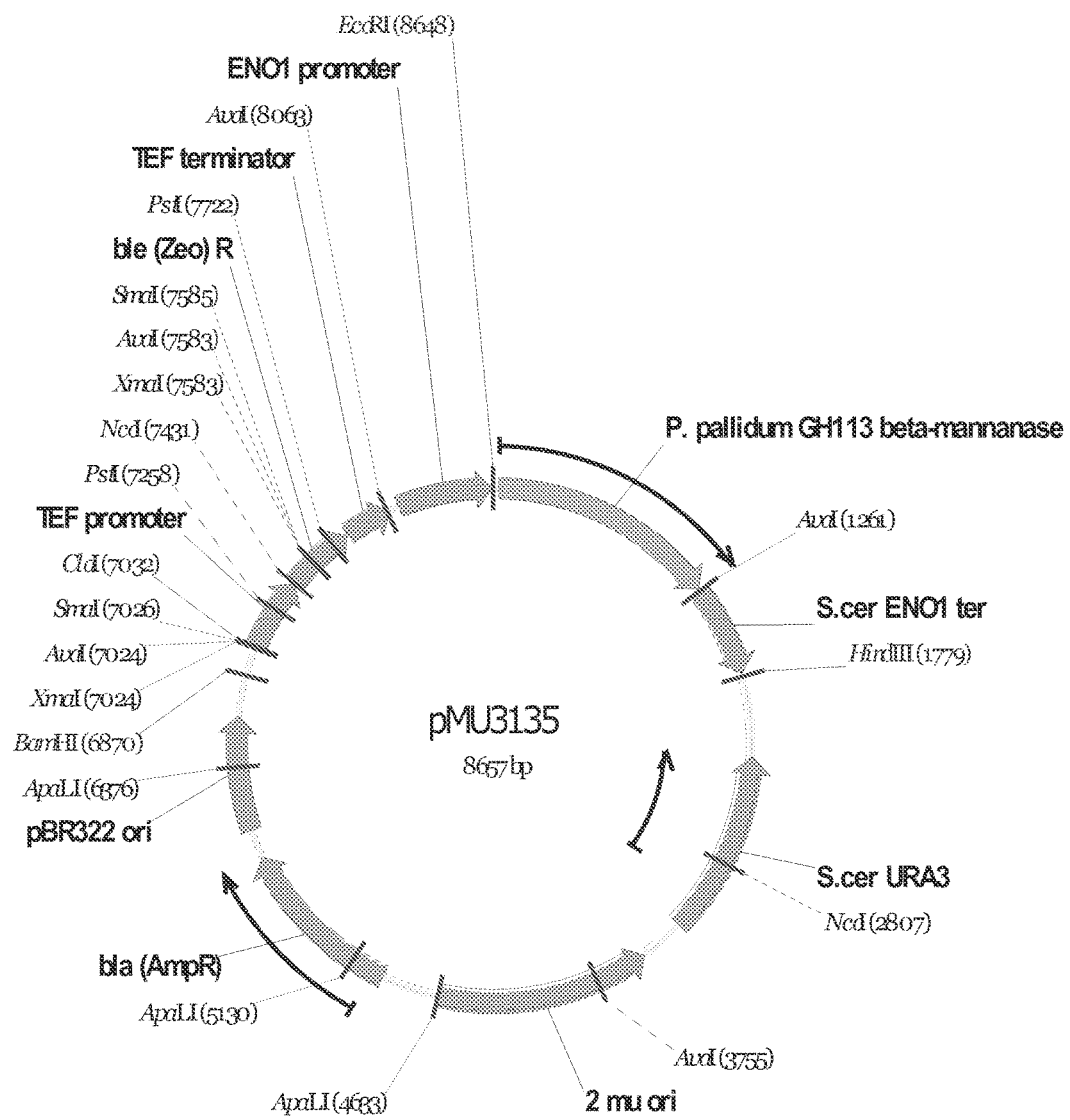
FIG. 63 depicts a plasmid map for pMU3135.
Figure 64:
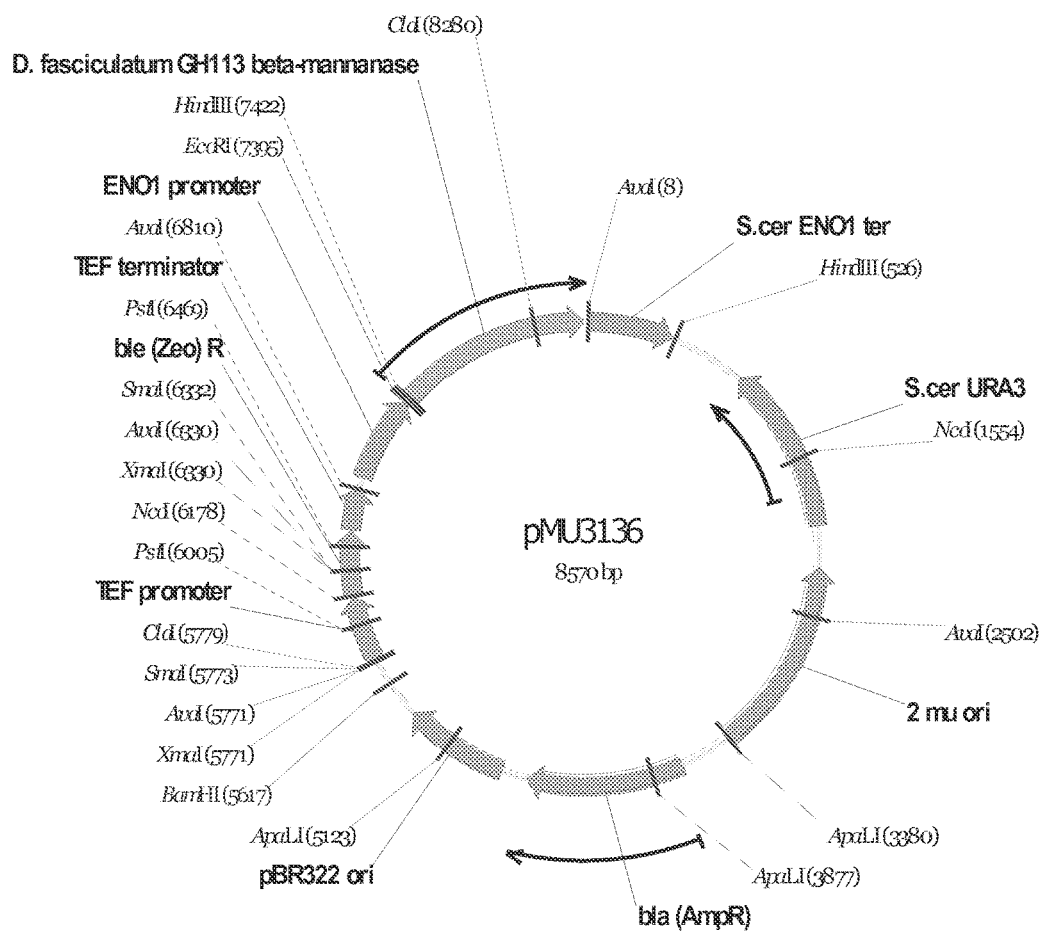
FIG. 64 depicts a plasmid map for pMU3136.
Figure 65:
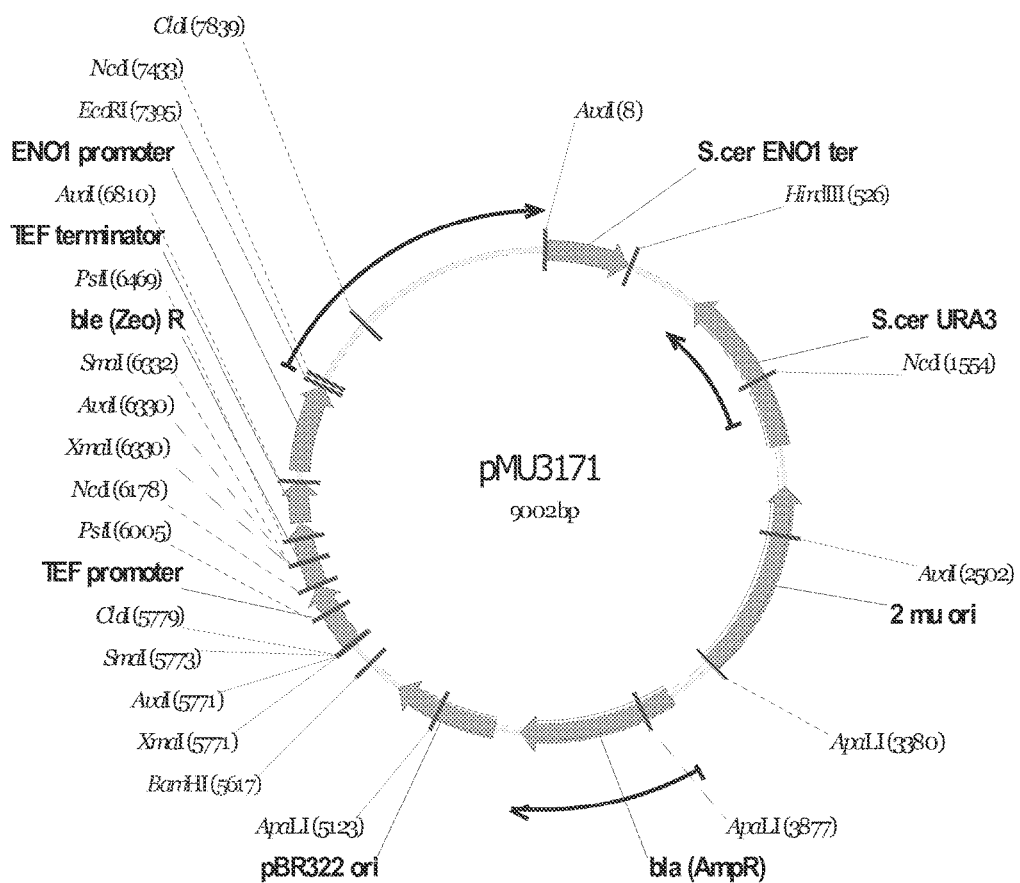
FIG. 65 depicts a plasmid map for pMU3171.
Figure 66:
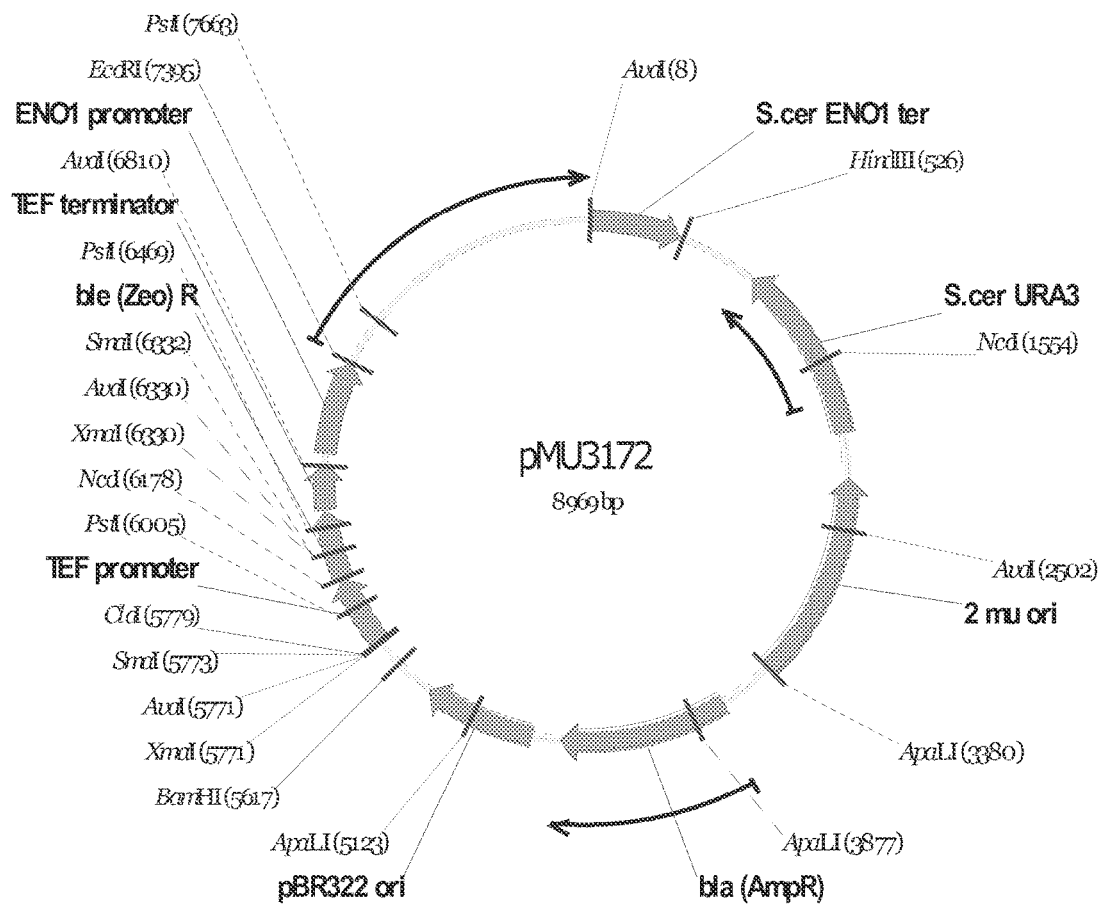
FIG. 66 depicts a plasmid map for pMU3172.
Figure 67:
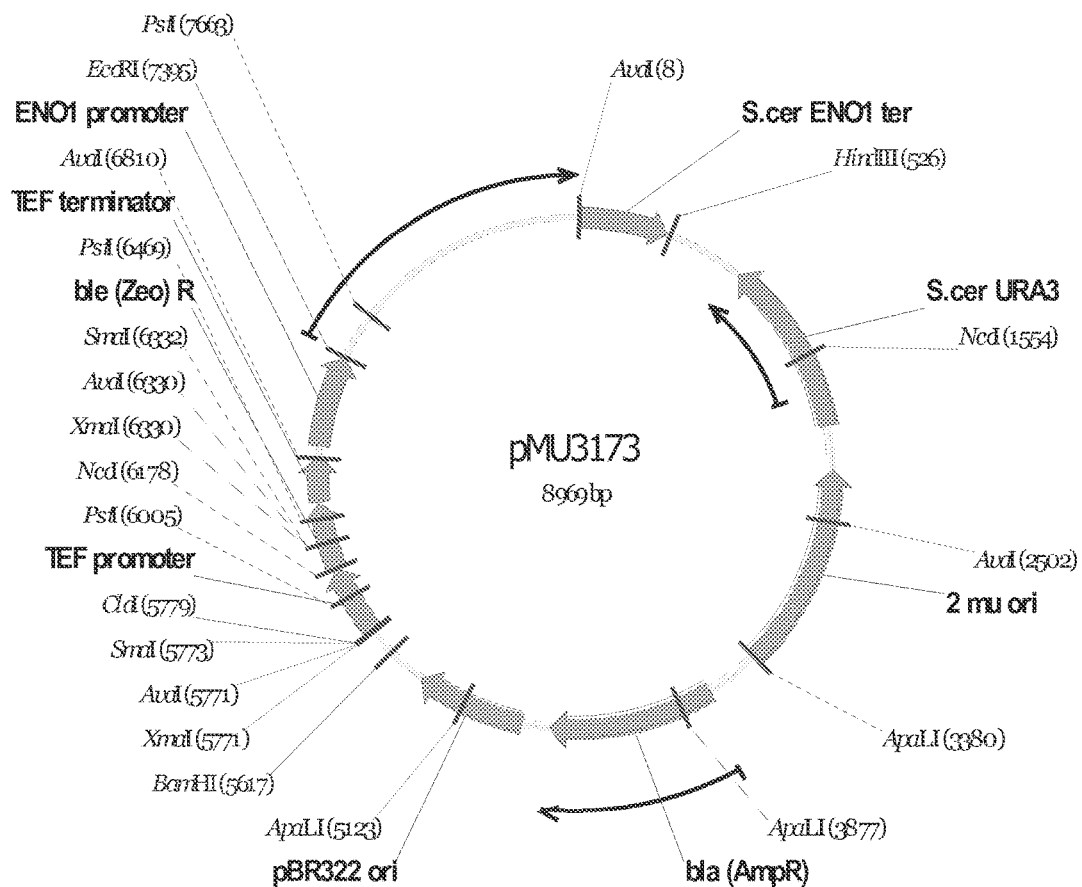
FIG. 67 depicts a plasmid map for pMU3173.
Figure 68:
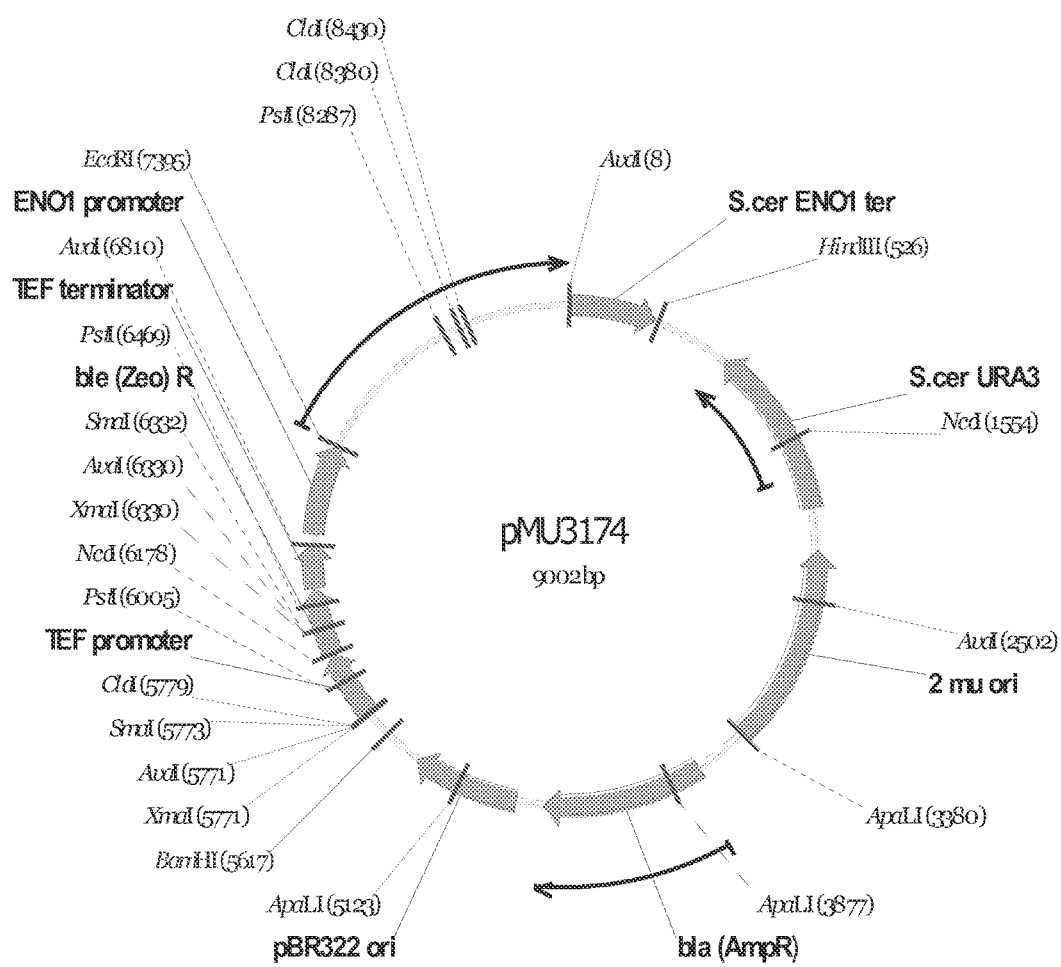
FIG. 68 depicts a plasmid map for pMU3174.
Figure 69:
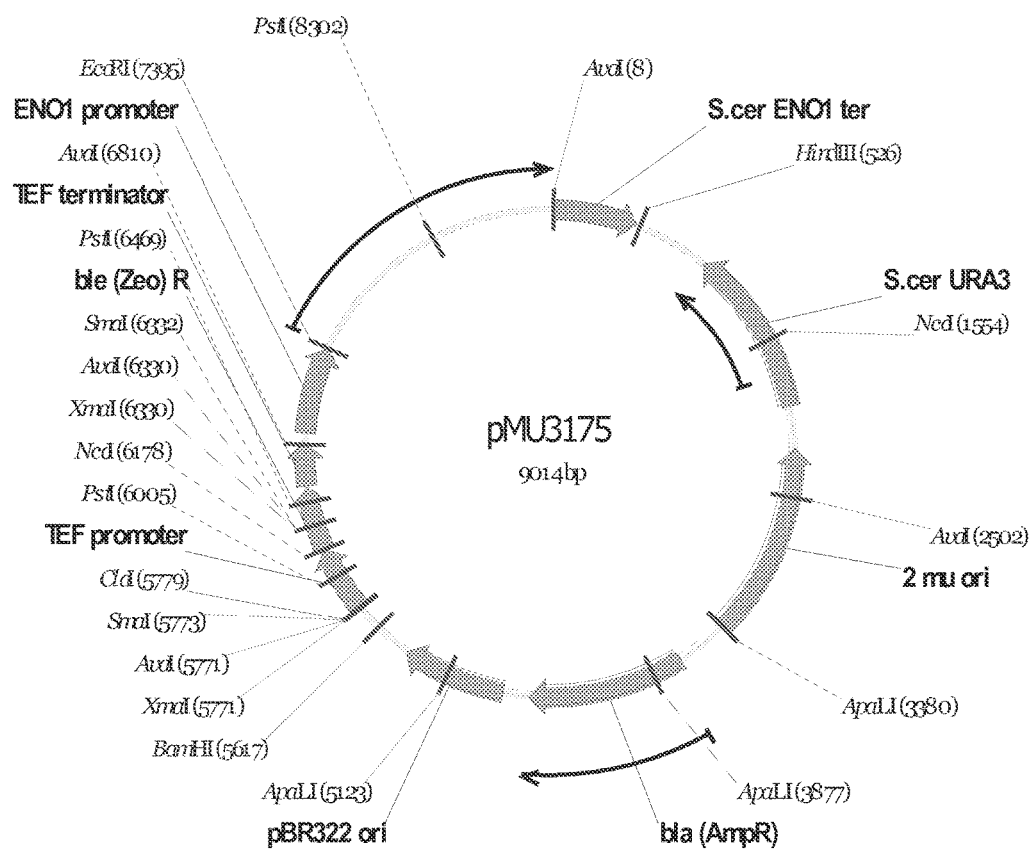
FIG. 69 depicts a plasmid map for pMU3175.
Figure 70:
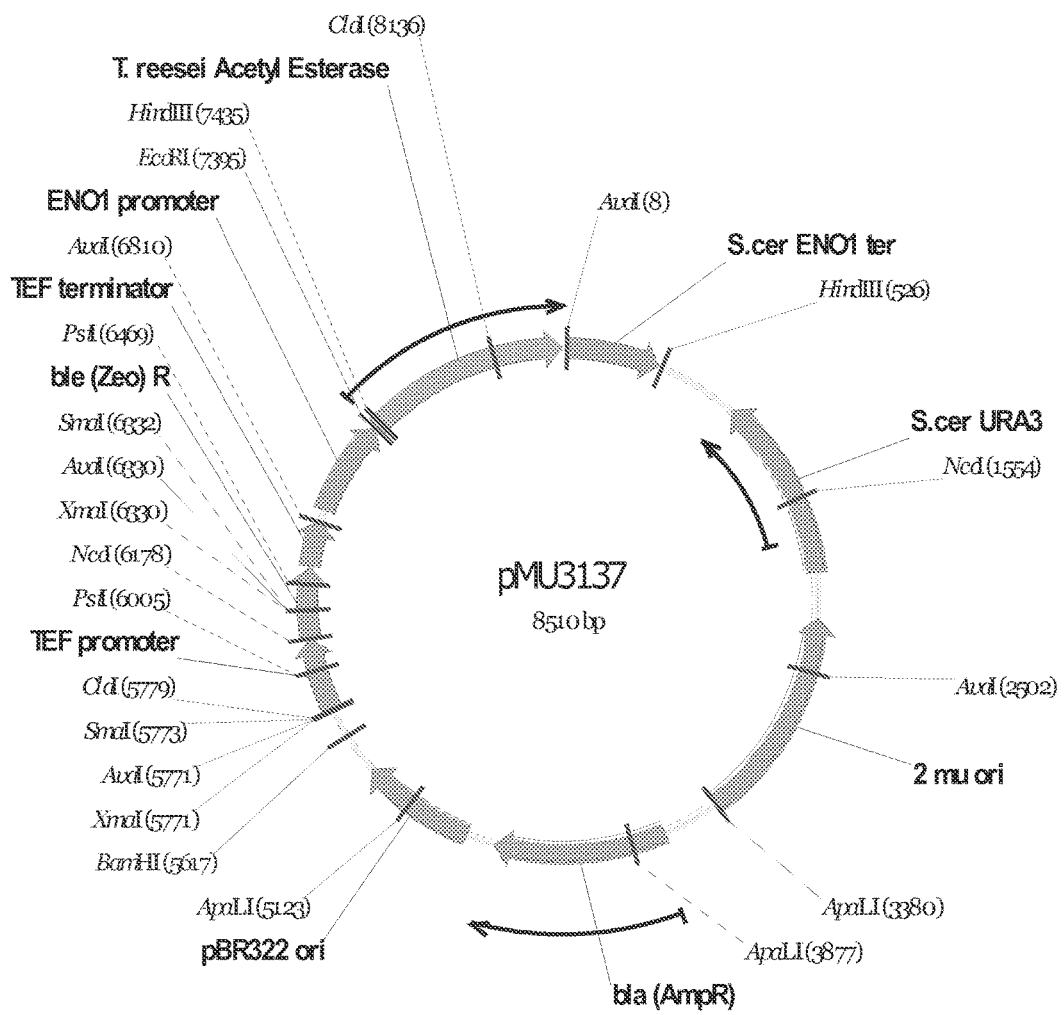
FIG. 70 depicts a plasmid map for pMU3137.
Figure 71:
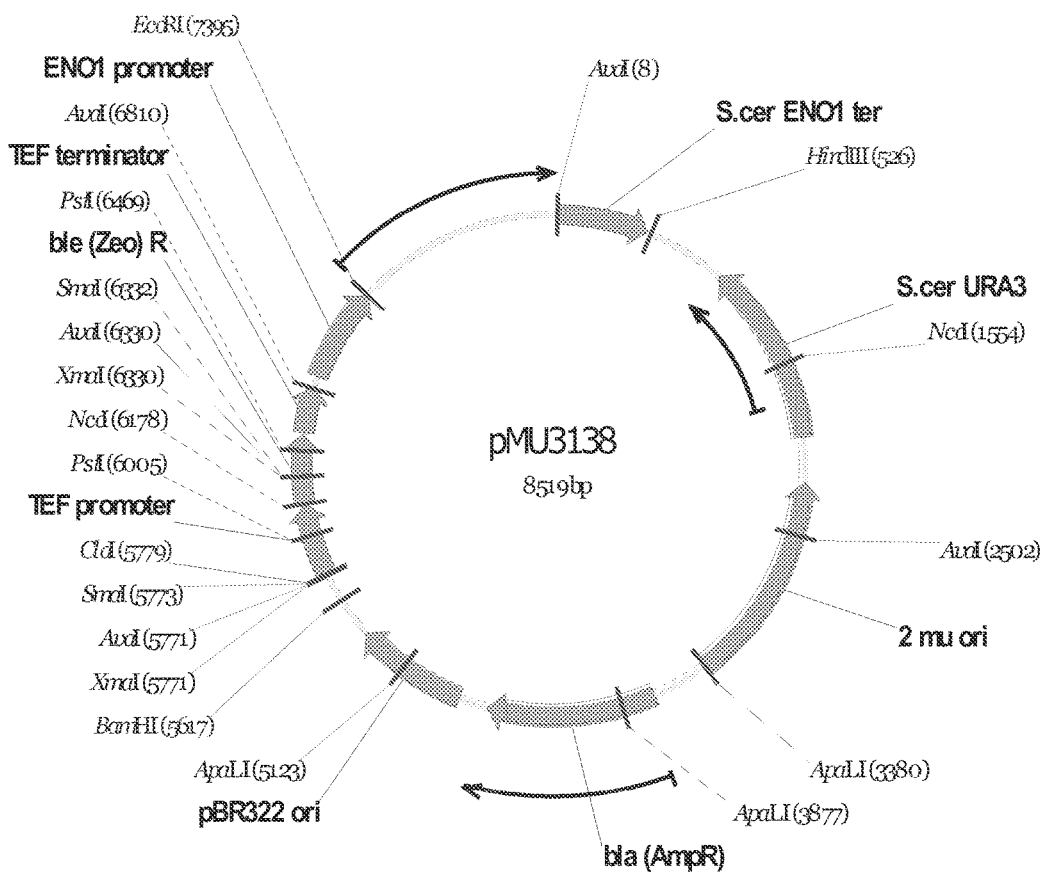
FIG. 71 depicts a plasmid map for pMU3138.
Figure 72:
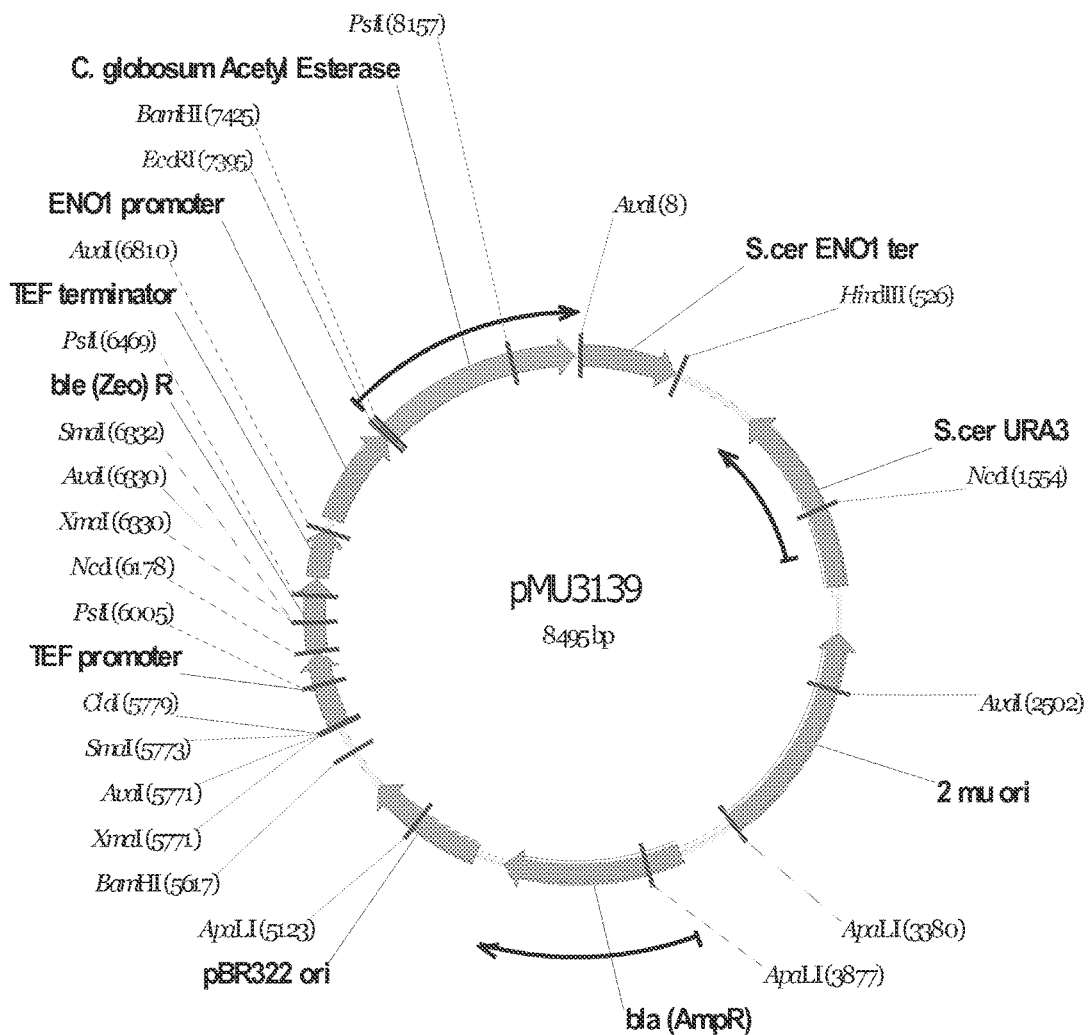
FIG. 72 depicts a plasmid map for pMU3139.
Figure 73:
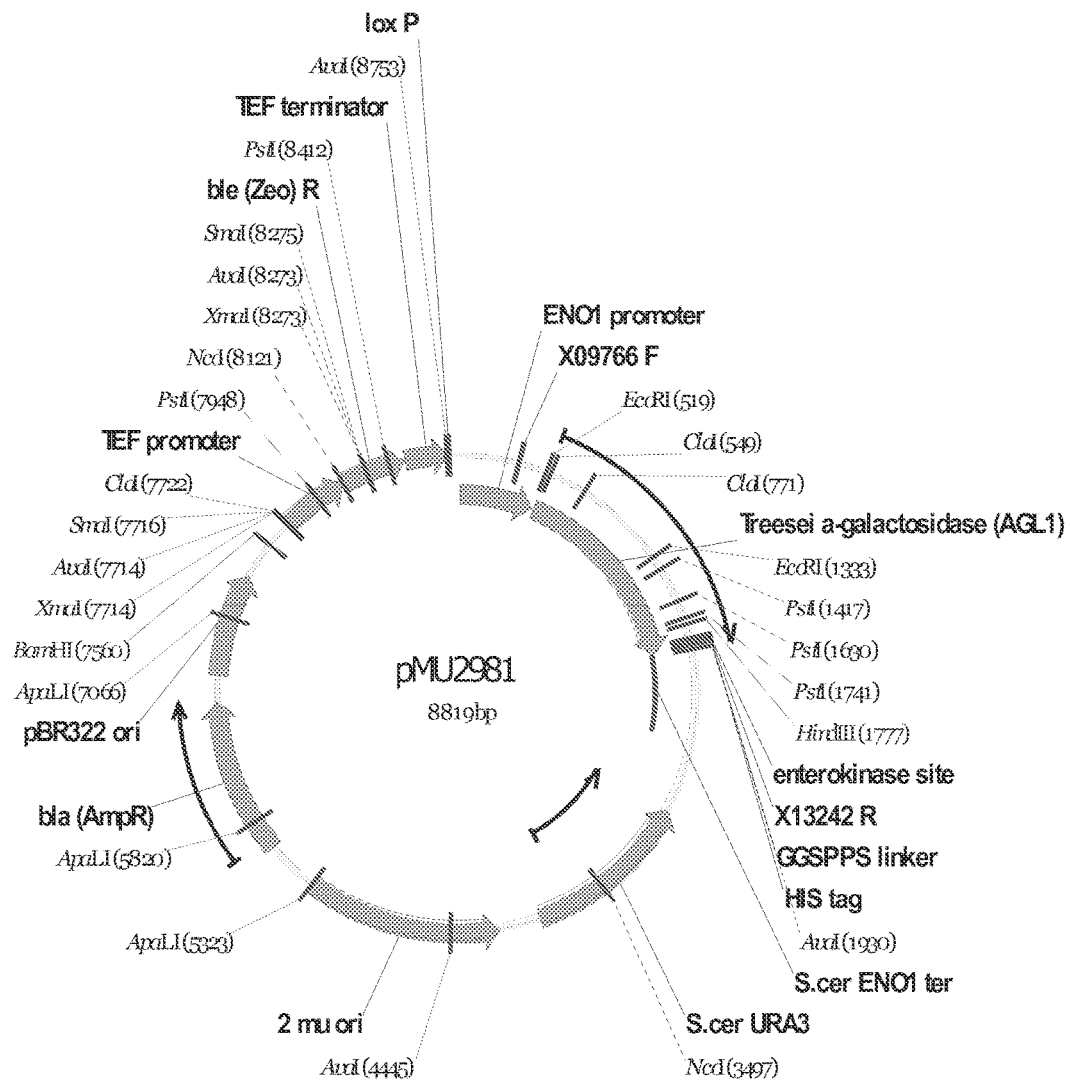
FIG. 73 depicts a plasmid map for pMU2981.
Figure 74:
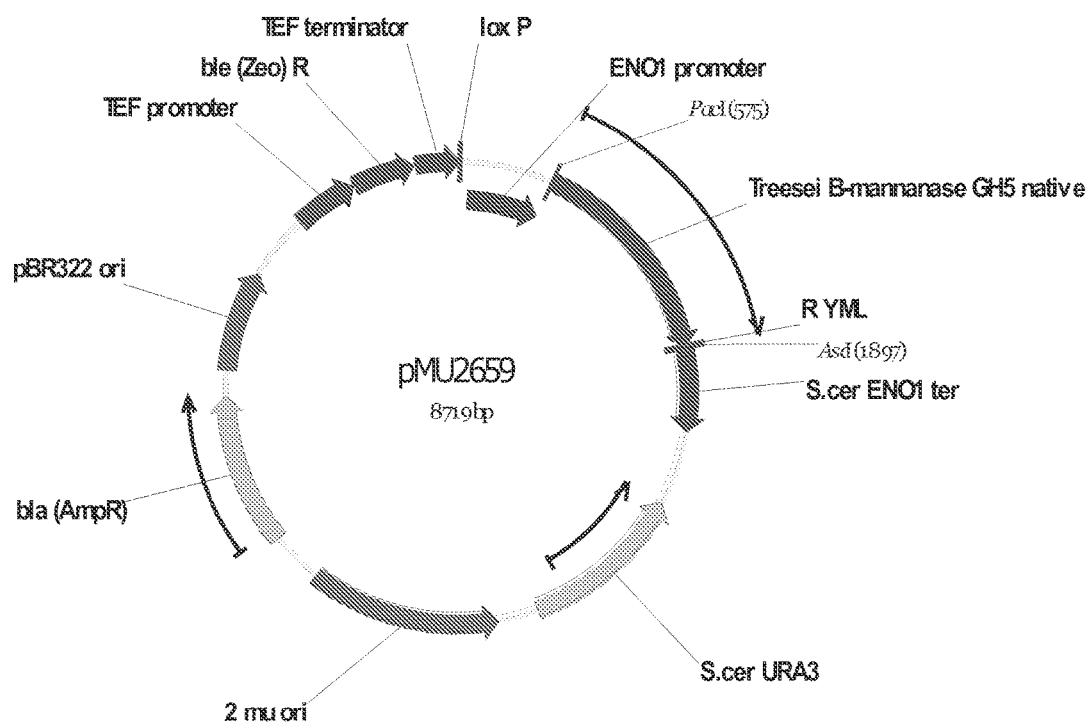
FIG. 74 depicts a plasmid map for pMU2659.

FIG. 27 depicts the impact of combining several strains producing several enzymes with M4059 in a co-culture. In this case, strains that produced FC124, FC88, FC72, FC140, and FC136) were added in small amounts (0.1 g/L each at inoculation) along with M4059 (0.5 g/L inoculation). As the data in FIG. 27 shows, the addition of these strains resulted in a ~25% increase in ethanol yield as compared to M4059, demonstrating the utility of these enzymes for hydrolysis. They also resulted in an increased release of acetate from the acetylated oligomers, producing 50% more free acetic acid and acetate (labeled as "acetate" in FIG. 27). The co-culture of strains was able to achieve ~71% of theoretical hydrolysis and fermentation of the oligomers present in 120 hours.

Example 4

Creation of M4638 and M4642, Robust and Efficient Xylose Utilizing S. cerevisiae Strains Derived from M3799

Figure 75:
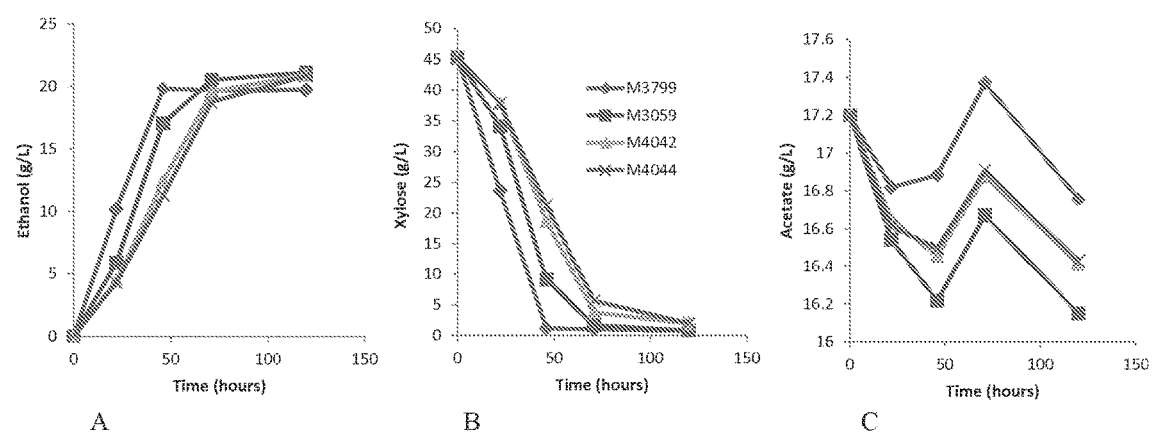
FIG. 75 depicts a comparison of several strains during batch fermentation of C5 liquor MS1011, which had been previously acid hydrolyzed to yield monomer sugar and loaded at 45 g/L total sugars. The fermentation started at pH 6.5 and contained CSL, DAP and $CaCO_3$. Time courses for ethanol production (FIG. 75A) and xylose consumption (FIG. 75B) are shown. The acetic acid concentration (FIG. 75C) for the fermentations is also shown.

Strain M3799, described above, was also engineered for glycerol reduction. Briefly, a gpd1 deletion was generated in M3799 with MA602 (Table 15). The *Bifidobacterium adolescentis* (*B. adolescentis*) adhE (acetaldehyde and alcohol dehydrogenase (bifunctional enzyme)) was integrated at the gpd1 locus by 5-fluorocytosine (5FC) counterselection with MA292 (Table 15) as detailed in Int'l Pub. No. WO2011/140386, which is incorporated herein by reference. The AADH integration was confirmed by polymerase chain reaction (PCR) and strains were tested for growth rates on xylose in the presence of acetate (YPX with 1 g/L acetate), as the strain utilizes acetate in order to displace glycerol production. The colonies were screened by measuring their growth rates in a BioTek 96 well plate reader equipped with the ability to incubate to 35° C. and shake. Measurements of optical density at 600 nm (OD600) were taken every 10 minutes for 48 hours and strains were compared against each other and to the benchmark M3799 strain. The strains with good growth on YPX with 1 g/L acetate were then tested for their ability to grow on hardwood derived C5 sugars. These comparisons were done by first hydrolyzing the liquor to monomer sugars by incubating with sulfuric acid at 121° C. in an autoclave, neutralizing to pH 6.0, and then loading them at starting concentrations of ~45 g/L of xylose in small batch fermentations carried out in nitrogen flushed bottles. Strains were inoculated at 0.5 g/L starting concentration and the media components added were 0.5 g/L diammonium phosphate (DAP) and 12 g/L corn steep liquor (CSL). M3799 was included as a bench mark strain as well as another glycerol reduction strain that had been adapted on xylose after engineering the xylose pathway, M3059, a derivative of M2433 which was described in Int'l Pub. No. WO2011/140386, which is incorporated herein by reference. M3799 outperformed the other strains tested in terms of rate of fermentation. Data for the fermentations is shown in FIG. 75, and from this data it can be seen that M4042 and M4044, two glycerol reduction strains, can complete the fermentation of xylose to ethanol in this toxic environment with an approximate 24 hr delay compared their parental strain M3799. However, the glycerol reduction strains both showed higher ethanol yield compared to the M3799 parental strain, reaching a yield of 0.46 grams of ethanol per gram of sugar consumed, whereas M3799 reached only 0.42 grams of ethanol per gram of sugar consumed. The glycerol reduction strains in this fermentation, M3059 (M2108 derived) and M4042 and M4044, all completed the fermentations with less acetate present (0.4-0.6 g/L less) as compared to M3799, as expected.

Example 5

Adaptation of M3799 and M4044 on C5 Liquor

Strains M3799 and M4044 (glycerol reduction) were subjected to adaptation on hardwood derived C5 liquor to improve their performance in these toxic conditions.

Figure 76:
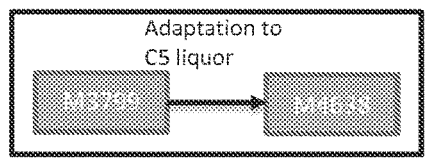
FIG. 76 depicts a comparison of M4638 to parental strain M3799 during batch fermentation of C5 liquor MS1063, which had been previously acid hydrolyzed to yield monomer sugar. C5 liquor was loaded at either 120 g/L or 84 g/L total sugars. Time courses for xylose consumption and ethanol production are shown. The acetic acid concentration for the fermentations are also shown. Fermentations were run at 35° C. at pH 6.0 (FIG. 76A) or 6.5 (FIG. 76B) and were inoculated at 0.5 g/L DCW of strain.
Figure 76:
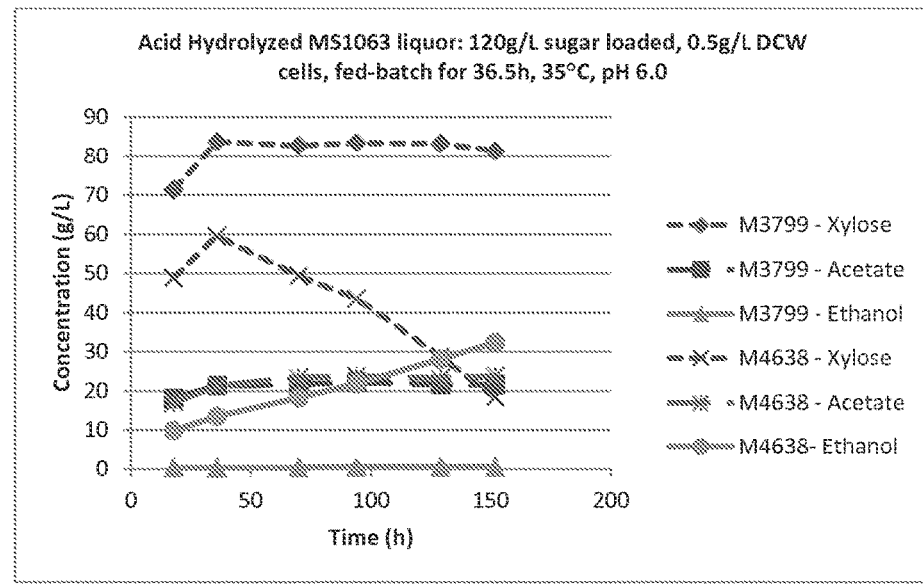
Figure 76:
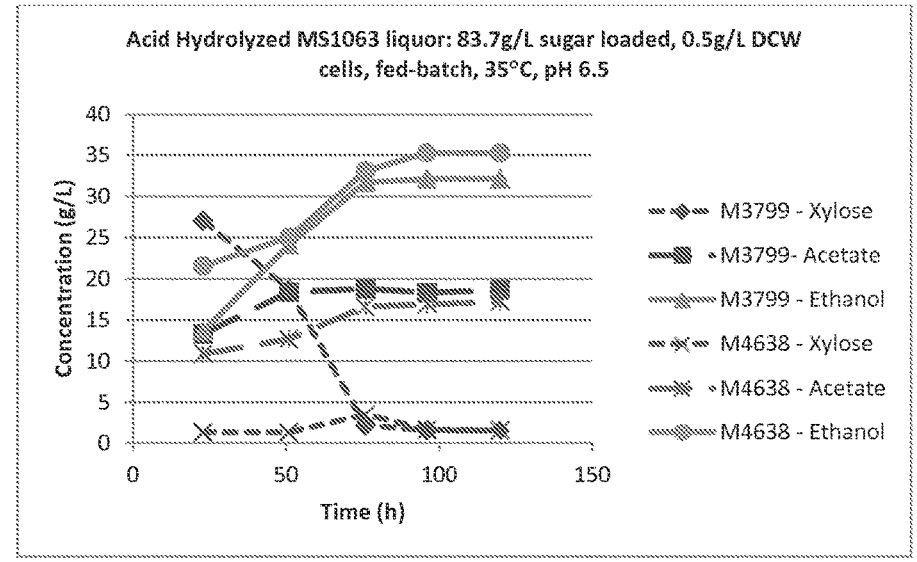

M3799 was adapted by serial transfer in small fermentation vessels. To create selection media. C5 liquor (MS1011) was acid hydrolyzed and diluted to approximately 30 g/L xylose. Nutrients (12 g/L CSL, 5 g/L CaCO$_3$, and 0.5 g/L DAP) were added for a total volume of 20 mL. M3799 was grown until significant pressure could be detected within the bottle, at which point a small amount was transferred to a new fermentation bottle. After the 20$^{th}$ fermentation, single colonies were isolated and screened for anaerobic growth rate on YPX and for performance on C5 hydrolyzed liquor compared to the parental strain, M3799. One isolate, strain M4638, was then compared to M3799 in 2 L bioreactors using a fed batch protocol with acid hydrolyzed C5 liquor at both 84 g/L and 120 g/L sugar loadings. At both loadings, M4638 performed better than M3799, the parent. At 84 g/L, M3799 achieved ~10% less ethanol than M4638, FIG. 76B. However, at 120 g/L, M3799 was unable to ferment the xylose at all, while the adapted strain M4638 fermented and produced ~30 g/L ethanol, FIG. 76A. The acid hydrolyzed liquor used in there reactors had ~20 g/L acetate, which likely killed the parental strain M3799. However, M4638 was able to ferment the xylose, likely due to an increase in inhibitor tolerance and overall robustness after adaptation on the C5 liquor.

The glycerol reduction strain M4044 was subjected to a different type of adaptation, namely repeat batch fermentations where the selection media was alternated between two types of media. One type was acid hydrolyzed C5 liquor, while the other was residual material from a solids fermentation (spent fermentation beer, containing ethanol produced during fermentation and other materials released during enzymatic hydrolysis of the solids), which was reconstituted with glucose. Prior to the alternating batch fermentations, the strain was subjected to mutagenesis by peroxide via the following protocol.

Peroxide Mutagenesis Protocol:
Kill Curve Generation
Procedure*:

* Based on Brennan et al., "Oxidative mutagens induce intrachromosomal recombination in yeast," Mutation Research 308 (1994) 159-167

1. Grow overnight culture in YPD
2. Prepare media** and aliquot (5 mLs used in this experiment)

** Media for this experiment is YNB w/ammonium sulfate, 5 g/L glucose, no amino acids 3. Add peroxide to desired concentration in each tube based on measured active peroxide concentration of stock solution
4. Measure OD600 of culture and inoculate proper volume to attain a starting OD600 of 0.1
5. Incubate at 35° C. overnight (17 hours)
6. Measure OD600 of each culture, making dilutions if necessary
7. Calculate percent survival based on OD600 of control culture For M4044, it was found that 100 ug/mL peroxide was appropriate to achieve an approximate 75% survival rate. The mutagenesis for this adaptation was done at 1 L scale in the reactor that the adaptation was to be run in to generate a large population of mutants.

After mutagenesis of M4044, the cells were washed and the vessel was re-sterilized. 1 L of YPD media was inoculated with the entire cell mass from mutagenesis. The automated repeat batch system (Sartorius Biostat unit controlled with Labview software) was used for fermentation monitoring and automated media transfer. Fermentations alternated between a C5 liquor or a spent beer as described above. Nutrients for the fermentations for both types of media were CSL (12 g/L) and DAP (0.5 g/L). Glucose was added to the spent beer media at a final concentration of 60 g/L, and both media were supplemented with penicillin to prevent bacterial contamination. After the 28$^{th}$ fermentation, single colonies were isolated and screened for performance compared to their parental glycerol reduction strain M4044.

Figure 77:
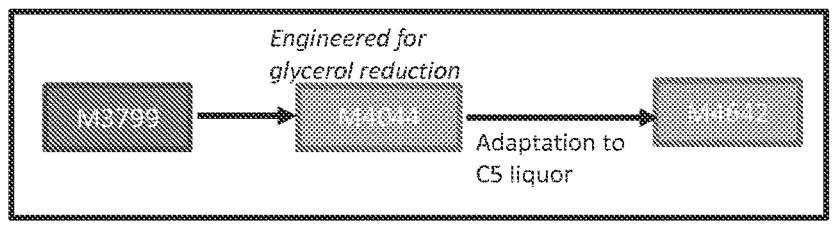
FIG. 77 depicts a comparison of the adapted glycerol reduction strain, M4642, to parental strain M4044 during batch fermentation of C5 liquor MS1063, which had been previously acid hydrolyzed to yield monomer sugar. C5 liquor was loaded at 84 g/L total sugars. Time courses for xylose consumption and ethanol production are shown (FIG. 77A). The acetic acid concentration for the fermentations are also shown (FIG. 77A). Fermentations were run at 35° C. at pH 6.0 and were inoculated at 0.5 g/L DCW of strain. The glycerol levels are shown for the 84 g/L loading to demonstrate the reduction in glycerol production in strains engineered with the glycerol reduction pathway (FIG. 77B).
Figure 77:
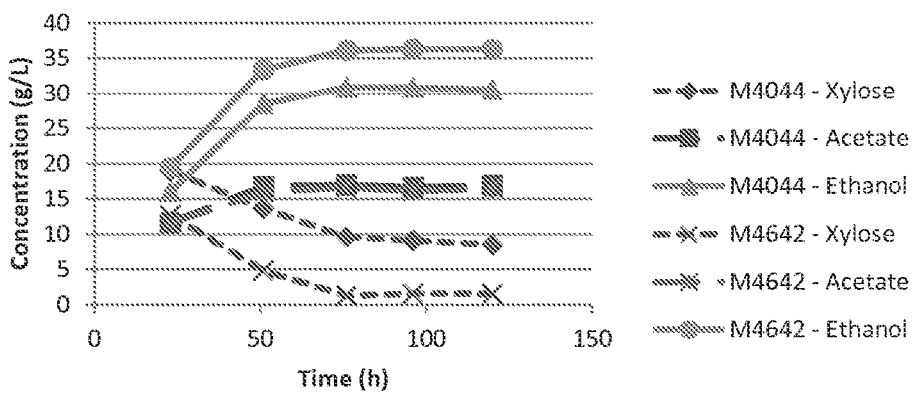
Figure 77:
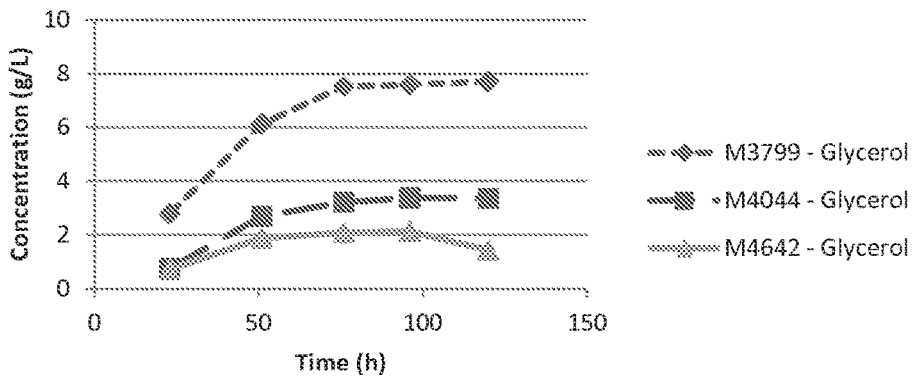

The top isolate identified, M4642, performed significantly better than the parental strain M4044 in C5 liquor fermentations, as can be seen in FIG. 77. At a feeding of 84 g/L total sugars in reactors, the background strain M4044 made ~30 g/L ethanol while the adapted strain, M4642, made >35 g/L ethanol, FIG. 77A. The glycerol levels for M4044 and M4642 were ~4 to 6 g/L lower than the parental strain M3799, FIG. 77B.

Example 6

Creation of Strains of M3799 Derived *S. cerevisiae* Engineered for Enzyme Expression and Consolidated Bioprocessing of Hardwood Derived Soluble Oligomers Enzymes were engineered into the M3799 derived strain, M4638, and the M4044 adapted glycerol reduction strain, M4642, to create CBP strains. These were constructed and screened as described above. Briefly, a strain was transformed with a particular MA as listed in the Table 14 and then screened for growth rate on xylose containing media (YPX) or xylose plus 1 g/L acetate containing media (YPX+A), with specific enzyme assay as listed above, for their ability to hydrolyze C5 liquor in nitrogen flushed pressure bottles, and finally in C5 liquor bioreactors. The top strains are listed in Table 14.

Figure 78:
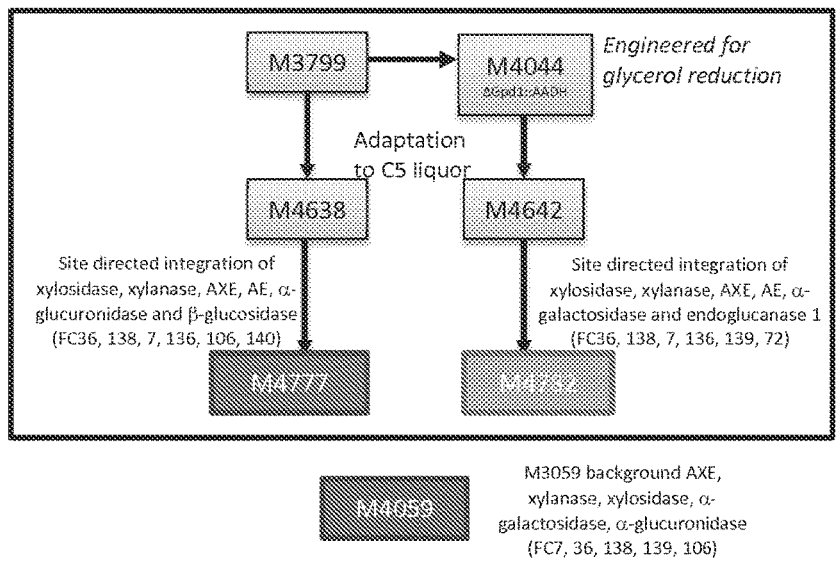
FIG. 78 depicts the performance of several M3799 derived CBP strains from a single round of engineering. Strains were tested for their ability to hydrolyze and ferment hardwood derived soluble oligomers (Substrate=MS1063). The experiment was carried out as a fed batch of concentrated oligomers to 110 g/L total sugars loading in 2 L working volume reactor with pH controlled at 6.0, temperature controlled at 35° C., and agitation at 300 rpm.
Figure 78:
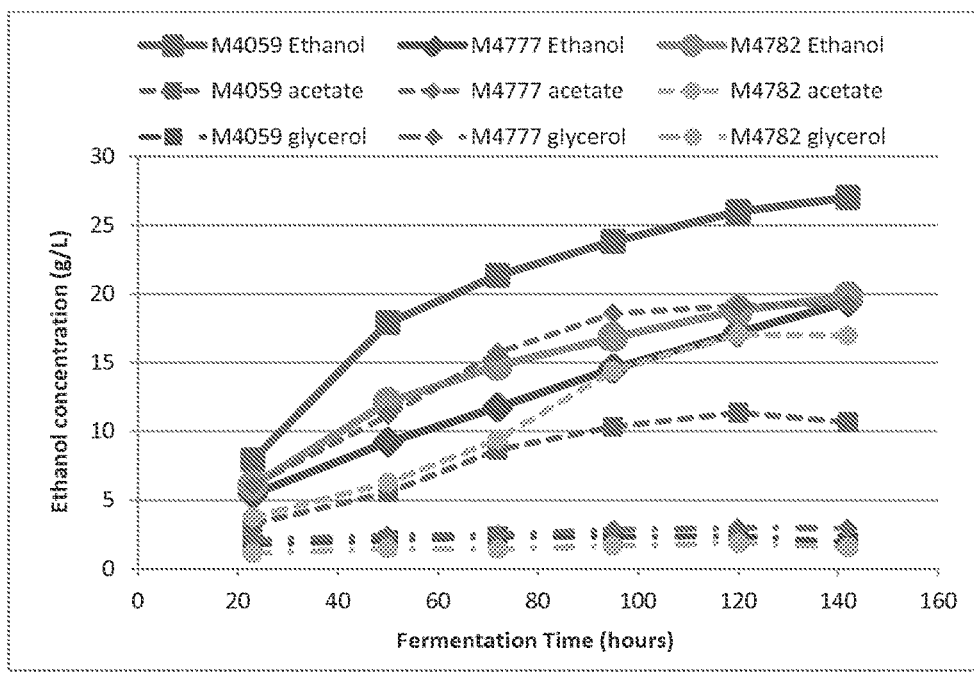

A first round of strains was constructed via site directed integration of the enzymes to the YLR296 locus. This differs from the construction of M3701, M3702 and M4059 described above which were built with multi-copy integrations. The benefit of site directed integrations is that it leads to much more genetic stability, of the integrated genes encoding the enzymes. The results for the top strains that were tested in C5 liquor fermentations in 2 L bioreactors are shown in FIG. 78. FIG. 78 shows two strains, M4777 and M4782 (glycerol reduction strain), compared to the multi-copy M4059 strain from FIGS. 26 and 27. A single transformation of the strain M4638 with FC36, FC138, FC7, FC136, FC106 and FC140 (xylosidase, xylanase, acetylxylanesterase (AXE), acetyl esterase (AE), α-glucuronidase and β-glucosidase) yielded strain M4777, which produced 19.8 g/L of ethanol. A single transformation of strain M4642, the glycerol reduction strain, with FC36, FC138, FC7, FC136, FC139 and FC72 (xylosidase, xylanase, AXE, AE, α-galactosidase and endoglucanase 1) yielded strain M4782. M4782 also produced 19.8 g/L ethanol but was consistently 2-3 g/L ethanol ahead of M4777 over the course of the fermentation while having ~1 g/L lower glycerol and 2-5 g/L less acetate. The glycerol reduction pathway in M4782 utilizes the acetate present in the C5 liquor to displace glycerol production from the strain as described above and in Int'l Pub. No. WO2011/140386, which is incorporated herein by reference. M4059 which has multiple copies of 5 genes has higher ethanol yield compared to these single round integration strains that express 6 genes at only 2-copy per gene (27 g/L vs 19.8 g/L ethanol). M4777 and M4782 ethanol yield is the equivalent of ~50% and 45% of theoretical hydrolysis yield, respectively, while M4059 is ~60%. Percent of theoretical hydrolysis yield was calculated assuming fermentation yield of 0.46 g ethanol per gram of carbohydrate consumed.

Figure 79:
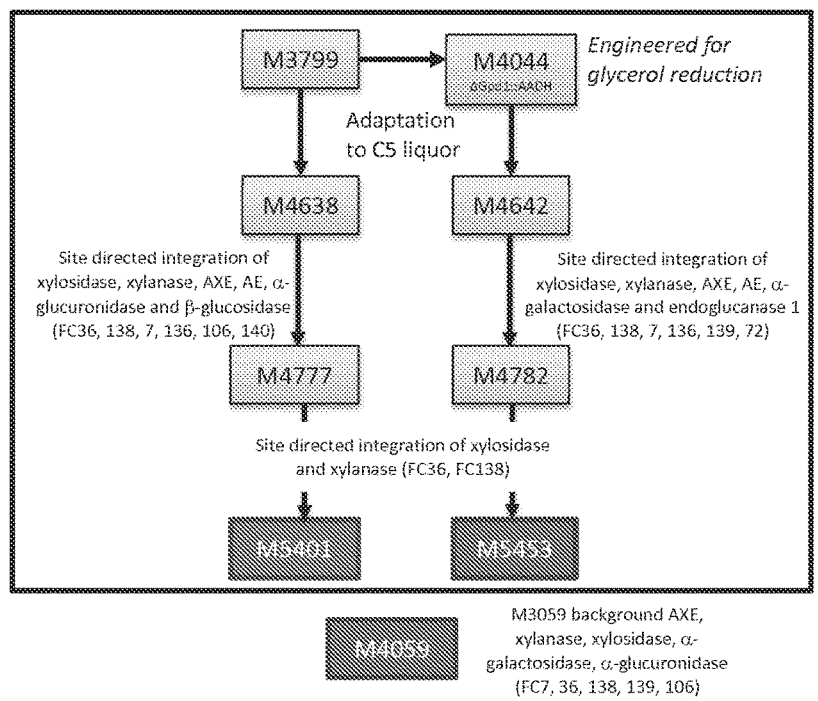
FIG. 79 depicts the performance of CBP engineered strains in hydrolyzing and fermenting hardwood derived soluble oligomers (Substrate=MS1080). Strains were constructed with two rounds of site directed engineering into M4638 and the glycerol reduction strain M4642. The experiment was carried out as a fed batch of concentrated oligomers to 86 g/L total sugars loading in 2 L working volume reactor with pH controlled at 6.0, temperature controlled at 35° C., and agitation at 300 rpm.
Figure 79:
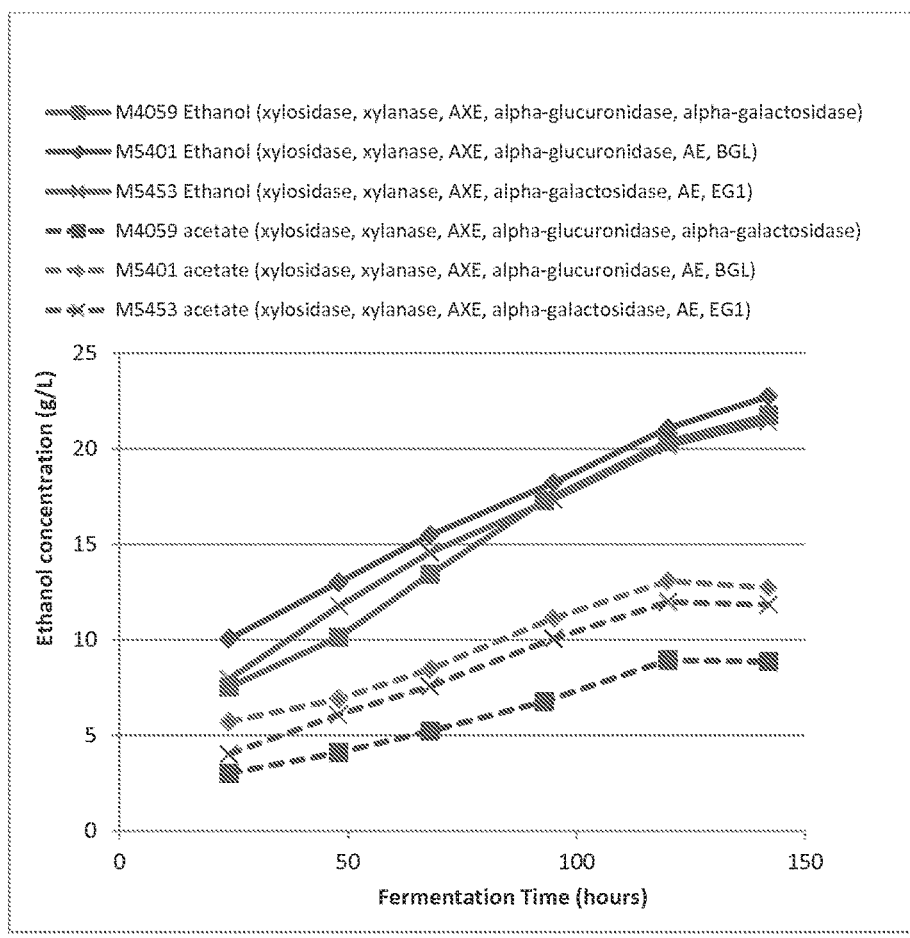
Figure 80:
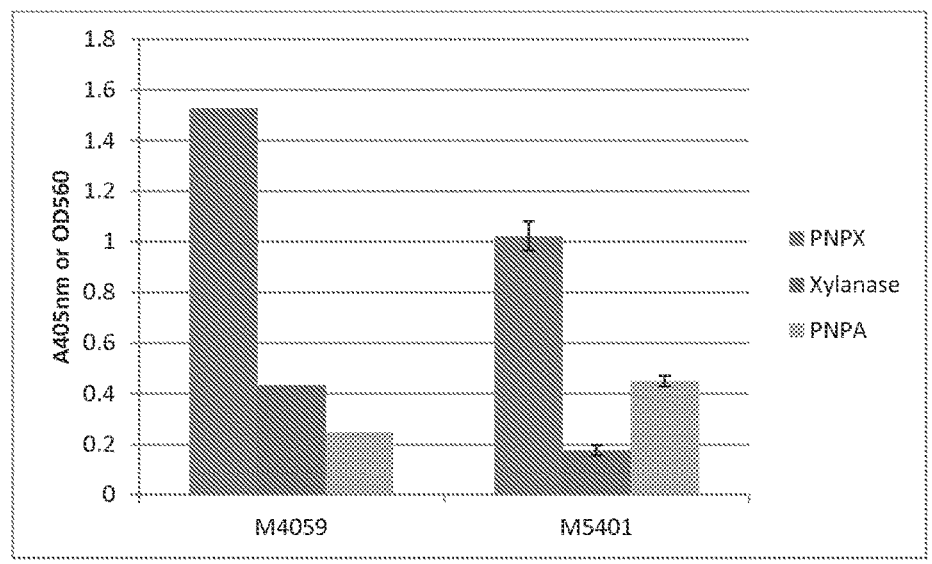
FIG. 80 depicts the secreted activity from top M3799 derived CBP strain. PNPX (left bar in each grouping of three bars), Birchwood xylan (middle bar in each grouping of three bars) and PNPA (right bar in each grouping of three bars) assays were used. M5401 was tested as biological replicates and compared to M4059, a M3059 derived CBP strain. Strains were grown aerobically for 48 hrs in YPD at 35° C., supernatants were harvested and used in standard enzyme assays.

FIG. 79 presents data from strains where 2 additional copies of xylosidase (FC36) and xylanase (FC138) were targeted to the APT2 (YDR441C) locus in M4777 and M4782. These strains were first marked with an antibiotic marker and a negative selection marker cassette at APT2 (MA513 and MA514, see Tables 14 and 15) to generate M4821 and M4836, respectively. Integration of MA715 into M4821 and M4836 produced M5401 and M5453, respectively (see Table 14). These strains showed increased xylosidase and xylanase activity compared to their parent strains in the PNPX and birchwood xylan assays described above. These strains were tested in 2 L reactors alongside M4059, the multi-site directed strain previously described. The performance of these strains was tested under lower C5 liquor loadings (86 g/L total sugars) to reduce acetate toxicity. M5453 and M4059 both reached ~21.5 g/L ethanol, while M5401 produced about 1.5 g/L more ethanol than M4059, an approximate 6% yield increase. The calculated percent of theoretical hydrolysis yield for M5453 and M5401 were 61% and 64% which is similar to the 63% theoretical hydrolysis yield of M4059. While the M5401 and M5453 strains secrete less enzyme at lab scale than M4059 (see activity data presented in FIG. 80) they perform as well as M4059 in these reactors, which is likely due to the superior growth characteristics of their parental strain M3799. The acetate release from M5401 and M5453 shows that the expression of the AXE (FC7) in combination with AE (FC136) in these strains is effective at removing ~90% of the acetate from the substrate while M4059, expressing only the AXE and not the AE, releases only ~60% of the theoretical acetate.

Example 7

Figure 81:
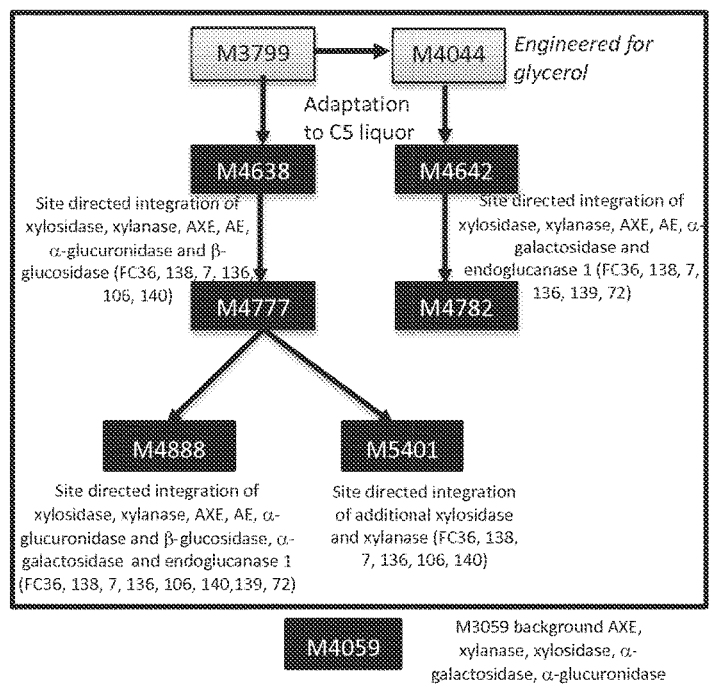
FIG. 81 depicts the secreted activity from an 8 enzyme expressing CBP strain, M4888. Birchwood xylan, PNPA, PNP-gal and PNPX assays were used. A number of CBP strains were tested for their secreted activity on substrates to determine xylanase, AXE, AE, alpha-galactosidase and xylosidase activity produced by these strains. Strains were grown aerobically for 48 hrs in YPD at 35° C., supernatants were harvested and used in standard enzyme assays as described above.
Figure 81:
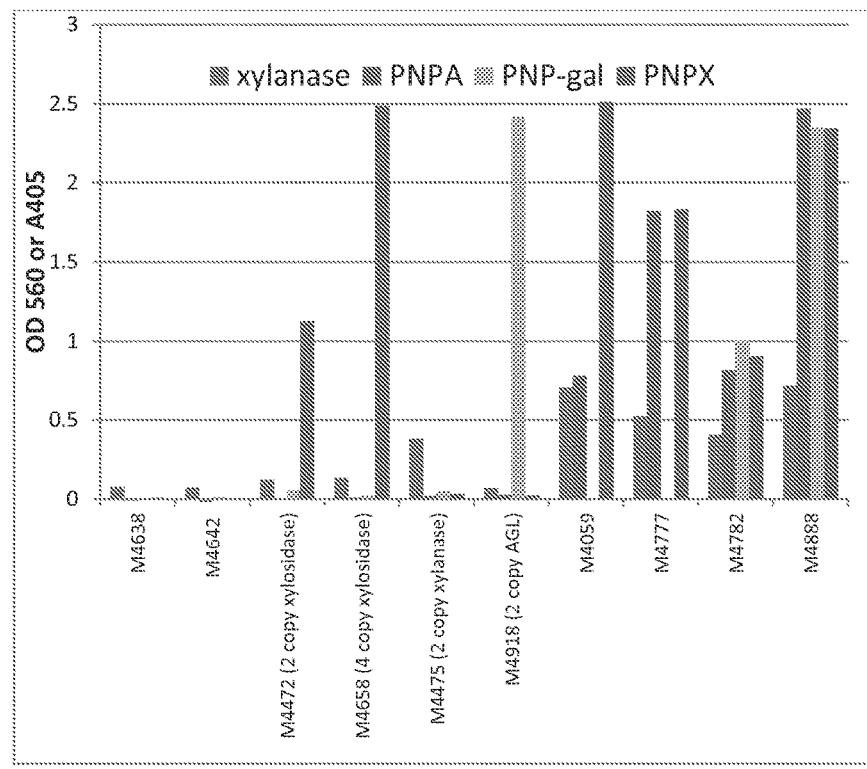
Figure 81:

Creation of Strains of an M3799 Derived *S. cerevisiae* Engineered for Expression of 8 Enzymes for the Consolidated Bioprocessing of Hardwood Derived Soluble Oligomers M4777 derived M4821, described above, was further engineered at the APT2 (YDR441C) locus with MA548 which encodes additional copies of xylosidase, xylanase, AXE and AE (FC36, FC138, FC7 and FC136) as well as two additional genes encoding α-galactosidase and endoglucanase 1 (FC139 and FC72). The new strains express a total of eight enzymes compared to the six enzymes expressed in M4777. The strains were screened via the enzyme assays described above and compared to the parental strain M4777 and additional control strains. The top strain M4888 showed an increase in xylanase, PNPA and PNPX activity compared to the parental strain M4777 (FIG. 81). In addition, the activity of the newly incorporated α-galactosidase was confirmed in the PNP-galactosidase assay (FIG. 81).

Figure 82:
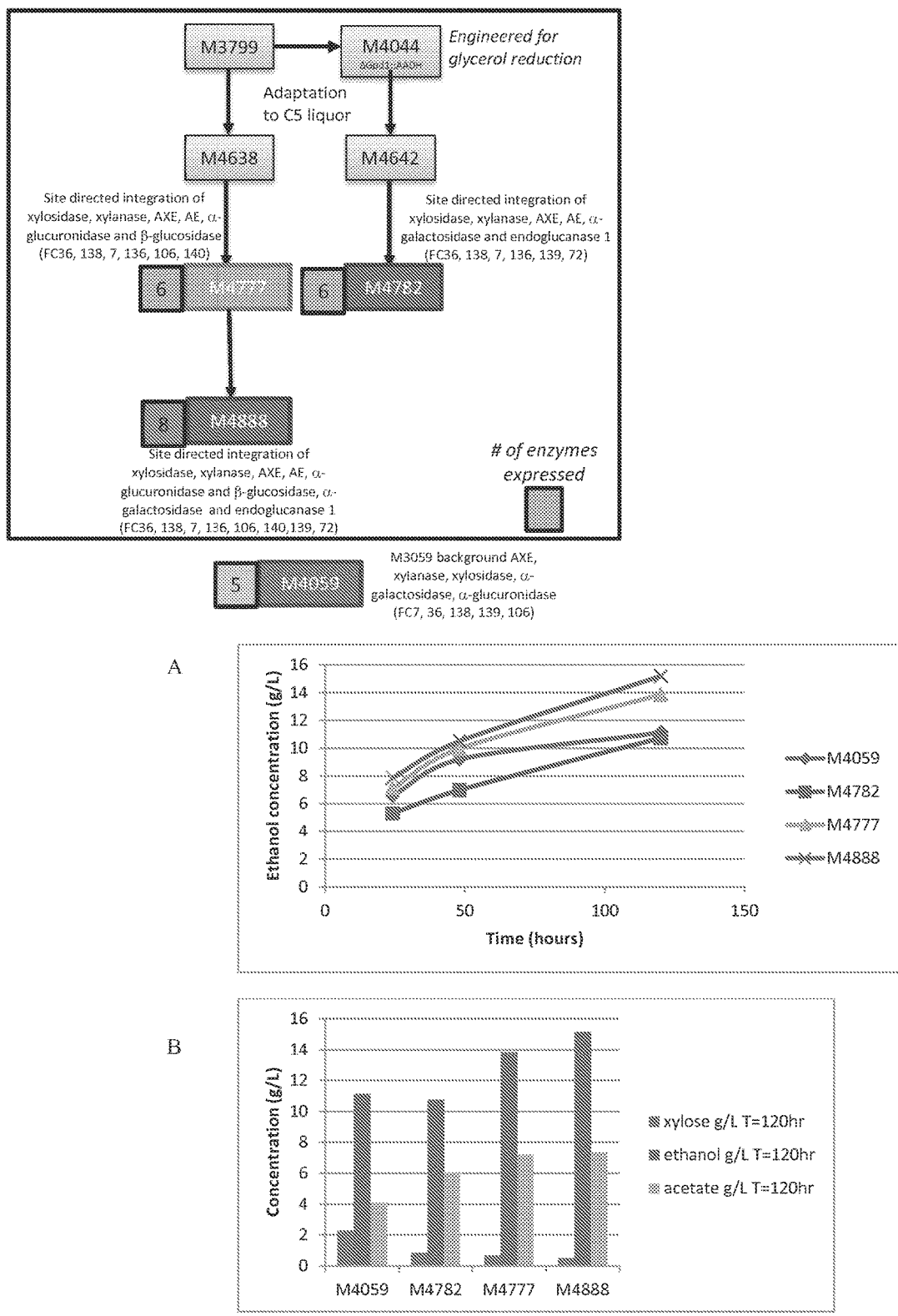
FIG. 82 depicts a comparison of several strains during batch fermentation of C5 liquor MS1063 loaded at 45 g/L total sugars with a 0.5 g/L DCW inoculum. The fermentation started at pH 6.5 and contained CSL, DAP and $CaCO_3$. The concentration of ethanol over time is shown (FIG. 82A). Xylose production, and ethanol production are shown (FIG. 82B).
Figure 83:
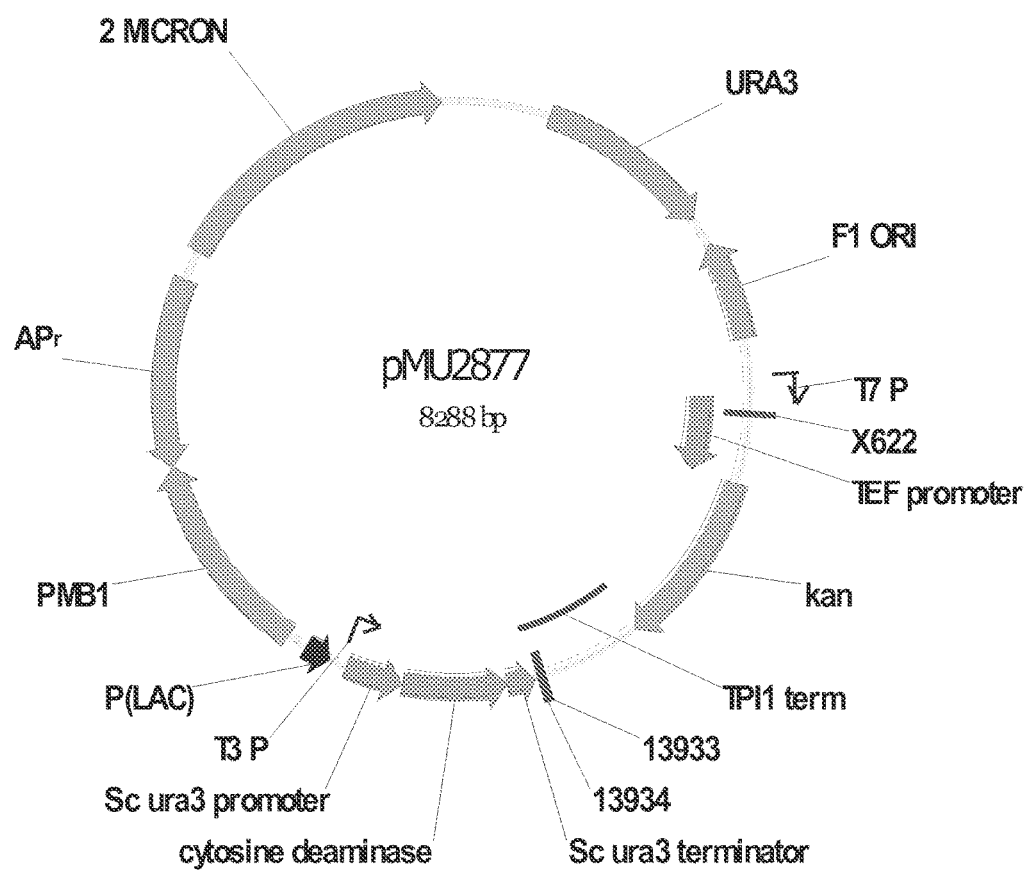
FIG. 83 depicts a plasmid map for pMU2877.
Figure 84:
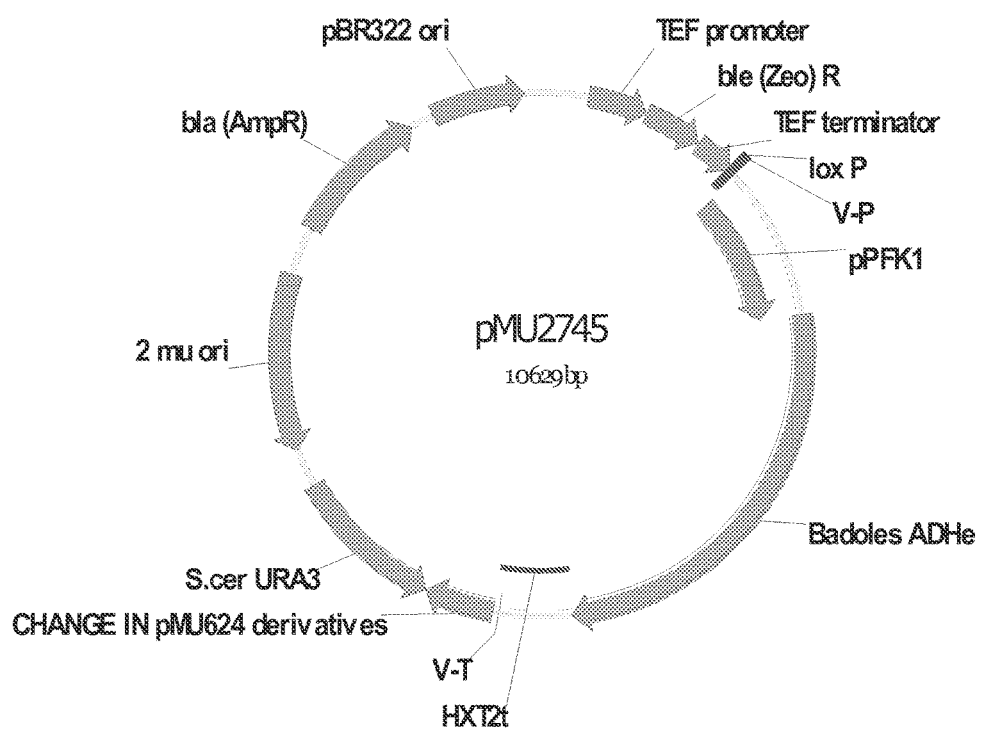
FIG. 84 depicts a plasmid map for pMU2745.
Figure 85:
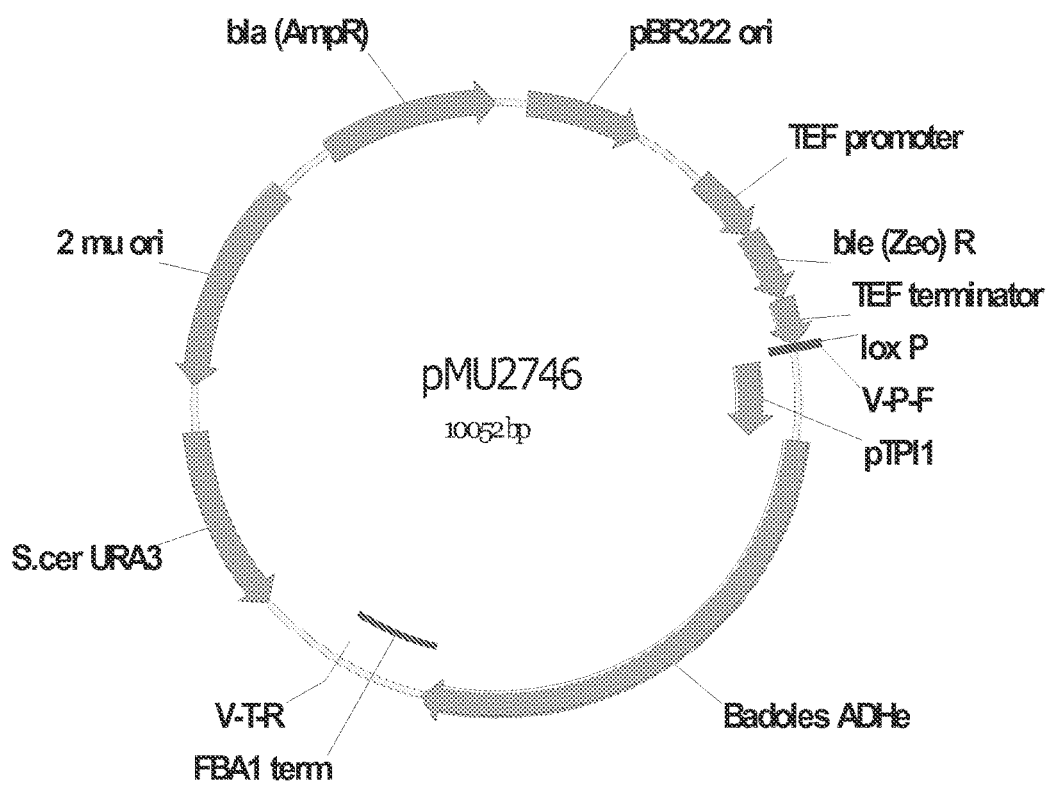
FIG. 85 depicts a plasmid map for pMU2746.
Figure 86:
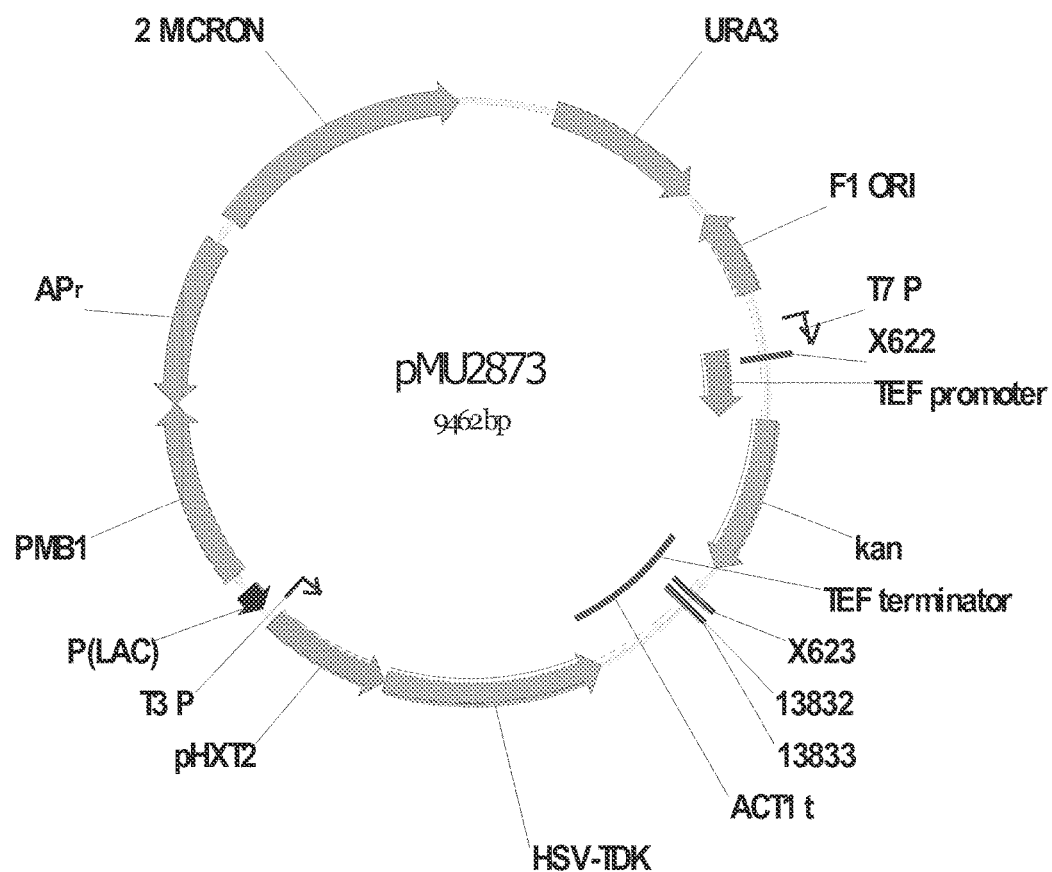
FIG. 86 depicts a plasmid map for pMU2873.
Figure 87:
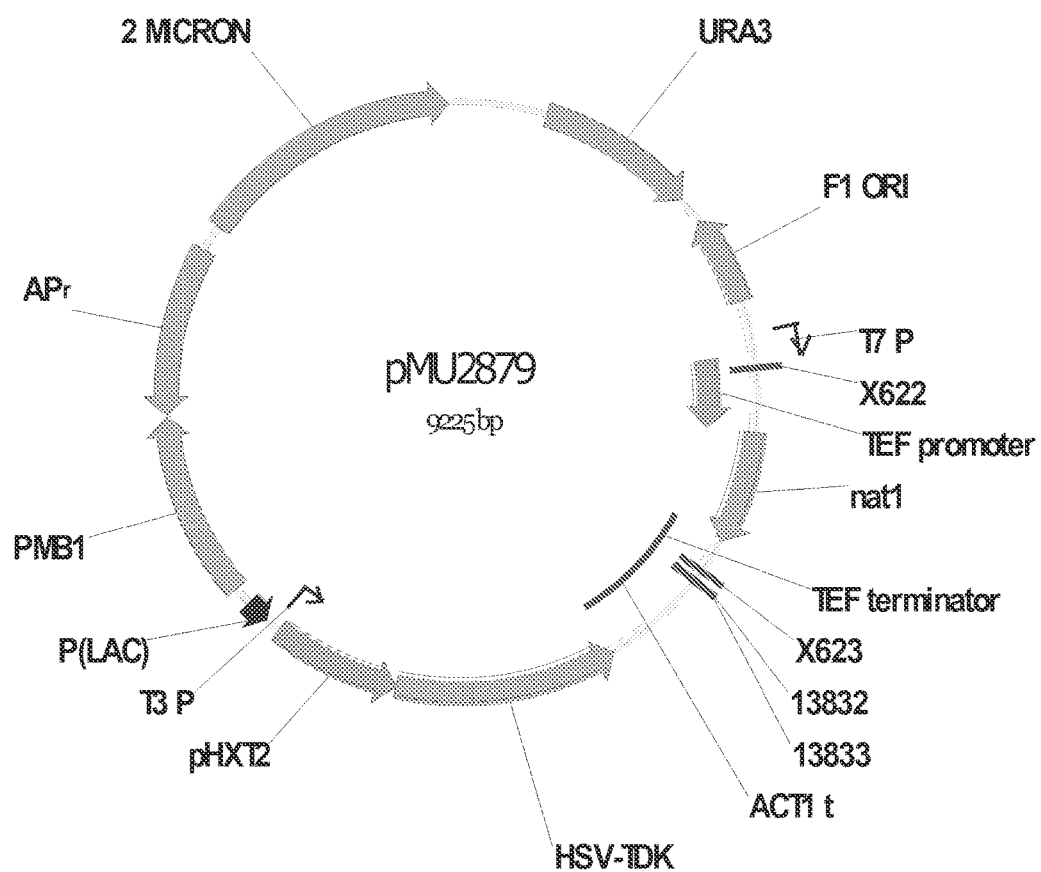
FIG. 87 depicts a plasmid map for pMU2879.

M4888 was then tested for its ability to hydrolyze C5 liquor in nitrogen flushed pressure bottles. These comparisons were done by first hydrolyzing the liquor to monomer sugars by incubating with sulfuric acid at 121° C. in an autoclave, neutralizing to pH 6.0, and then loading at a starting concentrations of ~45 g/L of xylose in small batch fermentations carried out in nitrogen flushed bottles. Strains were inoculated at 0.5 g/L starting concentration and the media components added were 0.5 g/L DAP and 12 g/L CSL. M4059 was included as a bench mark strain as well as the parental strain M4777. M4888 outperformed the other strains tested in these fermentations. Data for the fermentations is shown in FIG. 82. M4888 had a faster fermentation rate and produced 1.3 g/L more ethanol than M4777, and approximate 10%. The ethanol yield from M4888 is the equivalent of ~75% of theoretical hydrolysis yield while M4777 is 68%. The improvement in M4888 over M4777 is likely due to the higher levels of secreted enzymes in M4888 and the additional expression of α-galactosidase and endoglucanase 1.

Example 8

Figure 88:
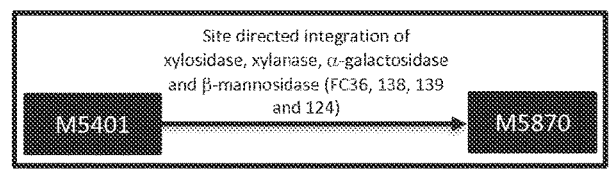
FIG. 88 depicts the secreted activity from an 8 enzyme expressing CBP strain. PNPX, PNPA, PNP-gal and AZCL-galactomannan assays were used. The CBP strains were tested for their secreted activity on substrates to determine the xylosidase, AXE/AE and alpha-galactosidase activity produced by these strains (FIG. 88A). Mannosidase activity was measured from CBP and control strains using the insoluble AZCL-galactomarman substrate which is hydrolyzed by mannosidase to a soluble blue solution (FIG. 88B). The strains were grown aerobically for 48 hrs in YPD at 35° C., the supernatants were harvested and used in standard enzyme assays described herein.
Figure 88:
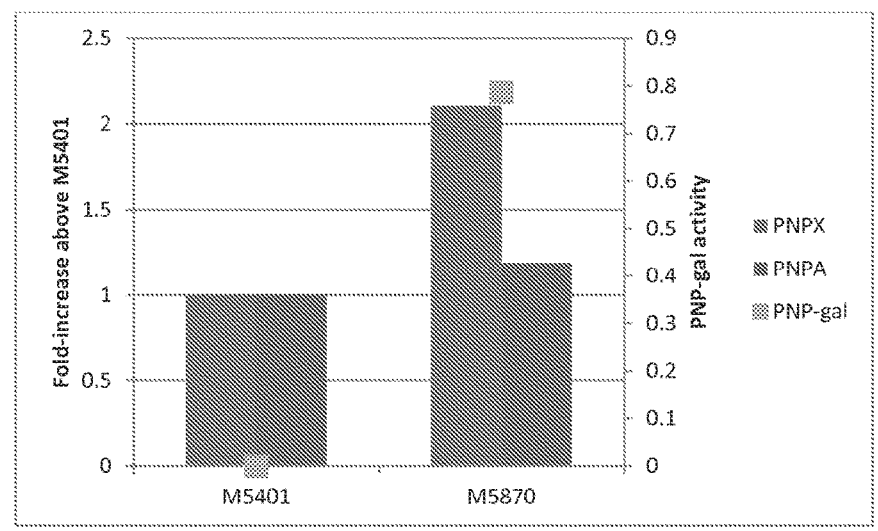
Figure 88:
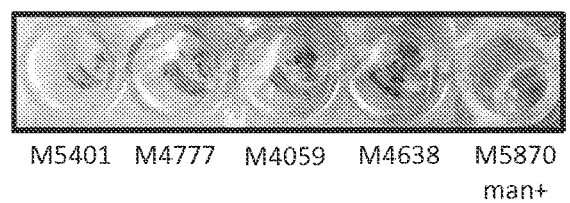

Creation of Strains of an M3799 Derived *S. cerevisiae* Engineered for Expression of 8 Enzymes Including a Mannosidase for the Consolidated Bioprocessing of Hardwood Derived Soluble Oligomers M4777 derived M4821, described above, was further engineered at the APT2 (YDR441C) locus with MA789 encoding additional copies of xylosidase and xylanase (FC36 and FC138) as well as two additional genes encoding β-mannosidase and α-galactosidase (FC124 and FC72). These strains are the result of three rounds of site directed integration into the M4638 background strain and have eight copies of xylosidase and xylanase genes (FC36 and FC138), two copies each of the AXE, AE, and α-glucuronidase, β-glucosidase, and α-galactosidase and β-mannosidase genes (FC7, FC136, FC106, FC140, FC139 and FC124). These strains expressing eight enzymes differ from M4888 described above in that they have twice as many gene copies of xylosidase and xylanase (FC36 ad FC138) as well as the expression of the mannosidase (FC124) instead of the endoglucanase I (FC72). The strains were screened via the enzyme assays described above and compared to the parental strain M5401. The top strain M5870 shows an increase in the PNPX assay measuring xylosidase activity. In addition, M5870 shows activity in the PNP-gal and AZCL-mannan for the newly integrated α-galactosidase and β-mannosidase genes (FIG. 88).

Figure 89:
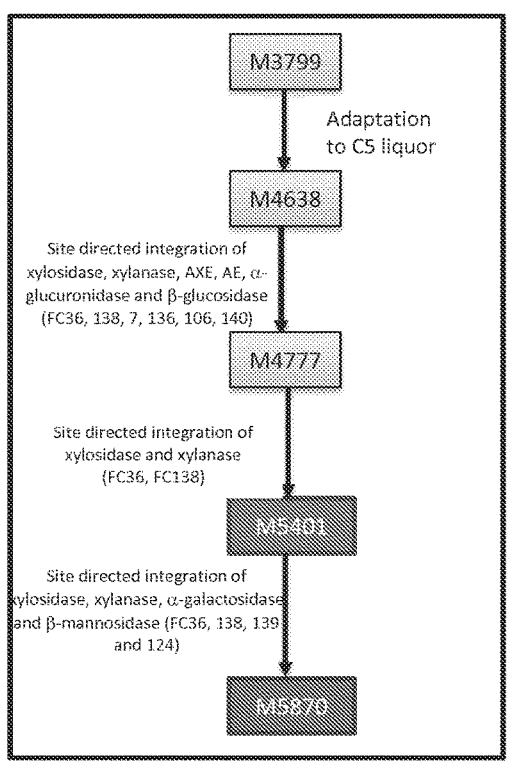
FIG. 89 depicts the performance of CBP engineered strains in hydrolyzing and fermenting hardwood derived soluble oligomers (Substrate=MS1103 C5 liquor). M5401 was constructed with two rounds of site directed engineering into M4638 and a $3^{rd}$ round of site directed engineering yielded M5870 from M5401. The experiment was carried out as a fed batch of concentrated oligomers at 86 g/L total sugars loading into a 2 L working volume reactor with pH
Figure 89:
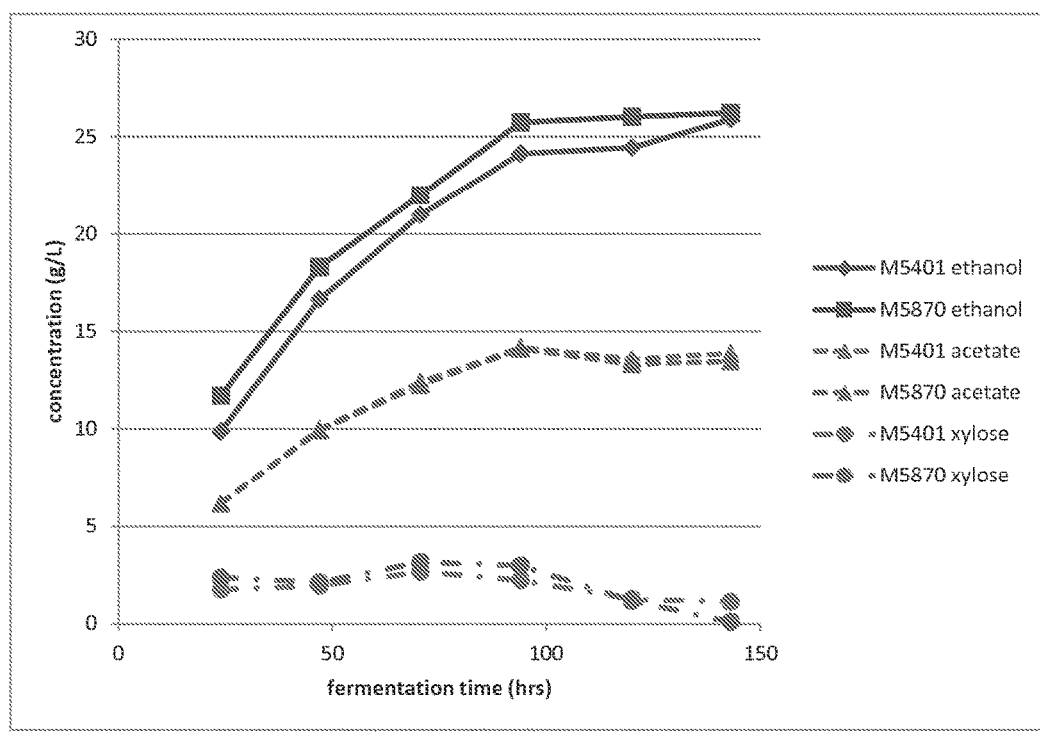

M5870 was then tested in 2 L reactors alongside the parental CBP strain M5401 at 33° C. and an 86 g/L total sugars loading of the C5 liquor. M5870 showed greater ethanol production for 120 hours and M5401 was only able to reach the same ethanol titer as M5870 after 140 hours of fermentation time (FIG. 89). At 120 hours M5401 reached ~24.5 g/L ethanol, while M5870 produced about 1.6 g/L more ethanol, an approximate 6% yield increase over M5401. The calculated percent of theoretical hydrolysis yield for M5401 and M5870 at 140 hours is ~67%, however, M5870 achieved this % of theoretical hydrolysis 24 hours earlier than M5401. The increased rate of hydrolysis for M5870 is likely due to the increased expression of the genes that were engineered into M5401 to generate M5870.

INCORPORATION BY REFERENCE

All documents cited herein, including journal articles or abstracts, published or corresponding U.S. or foreign patent applications, issued or foreign patents, or any other documents, are each entirely incorporated by reference herein, including all data, tables, figures, and text presented in the cited documents.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (602 sequences)

SEQ ID NO: 1 - DNA, 912 bp, Aspergillus niger
atgttgtctactcatttgttgtttttggctactactttgttgacttctttgtttcatccaattgctgctcatgttgctaaaagatctggttctttgcaacaaattactgattttggtgataatccaactggtgttggcatgtacatttacgttccaaacaatttggcttctaatccaggtattgttgttgctattcattattgtactggtactggtccaggttattactctaattctttctacgctactttgtctgaacaatacggtttcattgttatctatccatcttctccatattctggtggttgttgggatgtttcttcacaagctactttaactcataatggtggtggtaattctaattctattgctaacatggttacttggactatttctgaatatggtgctgattctaagaaagttttcgttactggttcttcttctggtgctatgatgactaatgttatggctgctacttatccagaattgtttgctgctggtactgtttattctggtgtttctgctggttgtttttactctgatacaaaccaagttgatggttggaactctacttgtgctcaaggtgatgttattactactccagaacattgggcttctattgctgaagcaatgtatccaggttattctggttctagaccaaaaatgcaaatttaccatggttctgttgatactactttgtacccacaaaattactacgaaacttgtaaacaatgggctggtgtttttggttatgattattctgctccagaatctactgaagctaatactccacaaactaattacgaaactactatttggggtgataatttgcaaggtatttttgctacaggtgttggtcatactgttccaattcatggtgataaagatatggaatggtttggttttgcatta

SEQ ID NO: 2 - DNA, 906 bp, Trichoderma reesei
atgccatctgttaaagaaactttgactttgttgttgtctcaagcttttttggctactggttctccagttgatggtgaaactgttgttaaaagacaatgtccagctattcatgtttttggtgctagagaaactactgtttctcaaggttatggttcttctgctactgttgttaacttggttattcaagctcatccaggtactacatctgaagctattgtttatccagcttgtggtggtcaagcttcttgtggtggtatttcttatgctaactctgttgttaatggtactaatgctgctgctgcagctattaacaatttccataactcttgtccagatactcaattggttttggttggttattctcaaggtgctcaaatttttgataatgctttgtgtggtggtggtgatccaggtgaaggtattactaatactgctgttccattgactgctggtgctgtttctgctgttaaagctgctattttcatgggtgatccaagaaatattcatggtttgccatataatgttggtacttgtactactcaaggttttgatgctagaccagctggttttgtttgtccatctgcttctaagattaagtcttattgtgatgctgctgatccatattgttgtactggtaatgatccaaatgttcatcaaggttacggtcaagaatatggtcaacaagctttggctttcattaattctcaattgtcatctggtggttctcaacctcctggtggtggtccaacttctacttctagaccaacttctacaagaactggttcttctccaggtccaactcaaactcattggggtcaatgcggtggtcaaggttggactggacctacccaatgtgaatctggtactacttgtcaagttatttctcaatggtactctcaatgctta

SEQ ID NO: 3 - DNA, 1107 bp, Neosartorya fischeri
atgagagctttgtctgttttttttgctttgttctgtttcttggctttatcttctgcttctccaggtcaagatgttgttaaaagagttacttctggttctttgcaacaagttactaattttggttctaatccatctggtactttgatgtacatttacgttccaaagaatttggctactaaaccaggtattgttgttgctattcattattgtactggtactgctcaagcttattatactggttctccatatgctcaattggctgaacaatacggttttattgttatctatccacaatctccatattctggtacttgttgggatgtttcttctcaatctgctttaactcataatggtggtggtgattctaattctattgctaacatggttacttggactatttctcaatacaatgctgatacttctaaggtttttgttactggttcttcttctggtgctatgatgactaatgttatggctgctacttatccagaattgtttgctgctgctactgtttattctggtgtttctgctggttgtttttactcttcatctaaccaagttgatgcttggaactcttcttgtgctcaaggtaatgttatttctactccagaagtttggggaggtattgctaaagcaatgtatccaggttatactggtccaagaccaagaatgcaaatttatcatggttctactgatactactttgtacccacaaaattactacgaaacttgtaaacaatgggctggtgtttttggttacaattacaactctccacaatctactcaatctaatactccacaagctaattaccaaactactatttggggtccaaatttgcaaggtatttttgctactggtgttggtcatactgttccaattcatggtgaacaagatatggaatggtttggttttgcaggtggttcttctactactactacacaaccaactactacttctactacaacatcttctggtggttcttcaactggtactggtgttgctgctcattggggtcaatgtggtggtaatggttggactggtccaactgtttgtgcttctggttatacttgtactgttgttaatgcttggtattctcaatgcttataa

SEQ ID NO: 4 - DNA, 966 bp, Streptomyces avermitilis
atggccctgttcgacctgcctctcgaccagctccgcggttatcgcagcgcgtcggccgagcccgaggacttcgacgccttctgggccaagacgctccaggaggcccgccagtacgacctcggtccccgtttcgagccggtcgagacgcacctcgagacggtcgaggtgtacgacgtcacgttcgccgggttcgacggtcacccggtgaagggctggctgacgctgcccgcccgggcgaacgcgccgctgccgacggtcgtggagttcatcgggtacggcggcggacgcggccttccgcacacgcatctgctgtgggcctcggccggcttcgcgcacttcgtgatggacacacggggccagggcagcgcgtggggcggcggtgacactcccgacccggtgggcagcgggcccgctttccccggattcatgacccggggggtggaggaccccgaaagctactactaccggcggctgttcaccgacggcgtccgtgccgtggaggcggcccgggcccatcccctgaccgactccgcccgcgtcgcggccgtcggcaccagccagggcggcggcatcacgatcgcggtgggcggcctggtccccgacctggccgcggtcgcgccggacgtgccgttcctgtgcgacttcccgcgcgcgacgacgctgacggaccgcgacccgtaccgcgagatcggcaggtacctcaagacgaaccgcggccgcacggagcaggtgcagcgcacgctgtcctacttcgacggcgtgcacttcgccgcccgcgggagcgctcccgcgctcttctccgcggccctcgaggaccagacgtgcccgccgtccaccgtcttcgccgccttcaacgcgtgggcgcacgccgacaaggcgatcgaggtgtacgacttcaacgaccacgagggcggcggcccctatcaggaggcggcacagctgcgctggctgccggaccgtcttcga

SEQ ID NO: 5 - DNA, 999 bp, Streptomyces avermitilis
atgcgaggtgccgtgcccgcattcgatctaccaccggccgaactggagaaccaccgccccgccccccacgagcccgccgatttcgacgccttctggcaggccaccctgaaggagtccgggcaggccgagccggtcctgtccgtgcggccgttcgacagcggcctgcggctggtcgagacctgggacgtgaccttccgcggcttcgccggcgacccggtgcgcgcctggtacacccggcccgccgaagccccgcgaccgctgccggccgtcgtcgagtacgcggggtacggacgcgggcgcggactcccgcacgagcggctcacctgggcggccgccgggtacgcccatctcctcatggacaaccggggccagggcgaccagtacgggtgcggcggcgacacccccgacccgcacgccacggcaccgagcggcccgggtccggccgtacgcggactgctggacccgcgcgactaccactaccggcgcctgatcaccgacgcggtgcgcgccgtcgccgccctgcgcgcgctgccgggggtggacggctcacgggtggcggcggtcggcaacagccagggcgggggactcgctctcgccgtcgccgggctcgtccccgacctcgcggccgtactggtcagcgcgcccttcctgtgcggcatccggcgcgccctcgaactcaccgacgccgccccgtacggtgagatcaccgcctatctcgccgtgcaccgcggcgccgaggcggctgcgtatcgcaccctctcctacgtcgagggcgtctccttcgcccggcgcgcgaccgcccccgcgcacttcgggatcggtctgcgcgacacggtctgcccgccgagcggcgcctacgccgcgtacaaccgctacgccgaactcaccggccacgaccccttgaaggagatccacccctacccgttcaaccagcacgaaggcggcgacgccgtccatgtgcgccgccaactcacttggctcgacggcatcctgggcggc

SEQ ID NO: 6 - protein, 304 aa, Aspergillus niger
MLSTHLLFLATTLLTSLFHPIAAHVAKRSGSLQQITDFGDNPTGVGMYIYVPNNLASNPGIVVAIHYCTGTGPGYYSNSFYATLSEQYGFIVIYPSSPYSGGCWDVSSQATLTHNGGGNSNSIANMVTWTISEYGADSKKVFVTGSSSGAMMTNVMAATYPELFAAGTVYSGVSAGCFYSDTNQVDGWNSTCAQGDVITTPEHWASIAEAMYPGYSGSRPKMQIYHGSVDTTLYPQNYYETCKQWAGVFGYDYSAPESTEANTPQTNYETTIWGDNLQGIFATGVGHTVPIHGDKDMEWFGFAL

SEQ ID NO: 7 - protein, 302 aa, Trichoderma reesei
MPSVKETLTLLLSQAFLATGSPVDGETVVKRQCPAIHVFGARETTVSQGYGSSATVVNLVIQAHPGTTSEAIVYPACGGQASCGGISYANSVVNGTNAAAAAINNFHNSCPDTQLVLVGYSQGAQIFDNALCGGGDPGEGITNTAVPLTAGAVSAVKAAIFMGDPRNIHGLPYNVGTCTTQGFDARPAGFVCPSASKIKSYCDAADPYCCTGNDPNVHQGYGQEYGQQALAFINSQLSSGGSQPPGGGPTSTSRPTSTRTGSSPGPTQTHWGQCGGQGWTGPTQCESGTTCQVISQWYSQCL

SEQ ID NO: 8 - protein, 368 aa, Neosartorya fischeri
MRALSVFFALFCFLALSSASPGQDVVKRVTSGSLQQVTNFGSNPSGTLMYIYVPKNLATKPGIVVAIHYCTGTAQAYYTGSPYAQLAEQYGFIVIYPQSPYSGTCWDVSSQSALTHNGGGDSNSIANMVTWTISQYNADTSKVFVTGSSSGAMMTNVMAATYPELFAAATVYSGVSAGCFYSSSNQVDAWNSSCAQGNVISTPEVWGGIAKAMYPGYTGPRPRMQIYHGSTDTTLYPQNYYETCKQWAGVFGYNYNSPQSTQSNTPQANYQTTIWGPNLQGIFATGVGHTVPIHGEQDMEWFGFAGGSSTTTTQPTTTSTTTSSGGSSTGTGVAAHWGQCGGNGWTGPTVCASGYTCTVVNAWYSQCL

SEQ ID NO: 9 - protein, 322 aa, Streptomyces avermitilis
MALFDLPLDQLRGYRSASAEPEDFDAFWAKTLQEARQYDLGPRFEPVETHLETVEVYDVTFAGFDGHPVKGWLTLPARANAPLPTVVEFIGYGGGRGLPHTHLLWASAGFAHFVMDTRGQGSAWGGGDTPDPVGSGPAFPGFMTRGVEDPESYYYRRLFTDGVRAVEAARAHPLTDSARVAAVGTSQGGGITIAVGGLVPDLAAVAPDVPFLCDFPRATTLTDRDPYREIGRYLKTNRGRTEQVQRTLSYFDGVHFAARGSAPALFSAALEDQTCPPSTVFAAFNAWAHADKAIEVYDFNDHEGGGPYQEAAQLRWLPDRLR

SEQ ID NO: 10 - protein, 333 aa, Streptomyces avermitilis
MRGAVPAFDLPPAELENHRPAPHEPADFDAFWQATLKESGQAEPVLSVRPFDSGLRLVETWDVTFRGFAGDPVRAWYTRPAEAPRPLPAVVEYAGYGRGRGLPHERLTWAAAGYAHLLMDNRGQGDQYGCGGDTPDPHATAPSGPGPAVRGLLDPRDYHYRRLITDAVRAVAALRALPGVDGSRVAAVGNSQGGGLALAVAGLVPDLAAVLVSAPFLCGIRRALELTDAAPYGEITAYLAVHRGAEAAAYRTLSYVEGVSFARRATAPAHFGIGLRDTVCPPSGAYAAYNRYAELTGHDPLKEIHPYPFNQHEGGDAVHVRRQLTWLDGILGG

SEQ ID NO: 11 - DNA, 984 bp, Aspergillus niger
atggttcagatcaaggtagctgcactggcgatgcttttcgctagccaggtactttctgagcccattgaaccccgtcaggcttcagtgagtattgataccaaattcaaggctcacgggaagaaatatcttggaaacattggtgatcagtacaccttgaccaagaactcgaagactccggccattatcaaggccgattttggcgcgttgactccagagaacagcatgaagtgggatgctactgaacccagccgtggacagttctctttctcaggatcggactacctggtcaactttgcccagtctaacaacaagctgatccgcggacatactctcgtgtggcactcgcagctcccctcctgggtccaatccatcacggacaagaatacactgatcgaagtcatgaagaatcacatcaccacagtgatgcaacactataagggcaagatttatgcctgggatgttgtcaatgaaatcttcaacgaagacggctccctacgcgacagcgtcttttacaaggtcatcggcgaggactacgtgcggatcgccttcgagactgctcgggctgcagatcccaatgcaaagctctacatcaatgattacaacctggattccgcctcctaccctaaattgaccggcatggttagccatgtcaagaagtggatcgcagctggcatccctatcgatggaatcggttcccaaacccacttgagcgctggtggaggtgctggaatttctggagctctcaatgctctcgcaggtgccggcaccaaggagattgctgtcaccgagcttgacatcgctggcgccagctcgaccgactacgtggaggtcgtcgaagcctgcctgaaccagcccaagtgtatcggtatcaccgtttggggagttgctgacccggattcctggcgctccagctccactcctctgctgttcgacagcaactacaacccgaagcctgcatacactgctatcgcaaatgctctctag

SEQ ID NO: 12 - DNA, 678 bp, Aspergillus niger
atgctcaccaagaaccttctcctctgcttcgccgcagctaaggctgttctggccgttccccacgactctgtcgtcgagcgttcggatgccttgcacaagctctctgagcgttcgaccccgagctcgaccggcgagaacaacggcttctactactccttctggaccgacggcggtggtgatgtgacctacaccaacggtgacgctggctcgtacaccgttgagtggtctaacgttggcaactttgttggtggaaagggctggaaccctggaagtgcgcaggacattacctacagcggcaccttcacccctagcggcaacggctacctctccgtctatggctggaccactgaccccctgatcgagtactacatcgtcgagtcctacggcgactacaaccccggcagtggaggcacctacaagggcaccgtcacctccgatggatccgtctacgatatctacacggctacccgcaccaacgccgcttccatccaaggaaccgctaccttcacccagtactggtccgttcgccagaacaagagagtcggaggaactgttaccacttccaaccacttcaacgcttgggctaagctgggcatgaacctgggtactcacaactaccagatcgtggctaccgagggctaccagagcagcggatcttcgtccatcactgttcagtaa

SEQ ID NO: 13 - DNA, 786 bp, Chaetomium thermophilum
atggtcaacttctctactttgtttttggctgcttctactgctgctttggctgctgctgctccatctattgaaaaaagacaaaccttgacttcttctgctactggtactcataatggttactactactctttttggactgatggtcaaggtaatattagattcaacttggaatctggtggtcaatattctgttacttggtctggtaatggtaattgggttggtggtaaaggttggaatccaggtactgataatagagttattaactacactgctgattatagaccaaatggtaattcttatttggctgtttatggttggactagaaatccattgattgaatactacgttgttgaatcttttggtacttatgatccatctactggtgctactagaatgggttctgttactactgatggtggtacttacaatatctacagaacccaaagagttaacgctccatcaattgaaggtactaagactttttatcaatactggtctgttagaacttctaaaagaactggtggtactgttactatggctaatcattttaatgcttggagacaagctggtttgcaattgggttctcatgattatcaaattgttgctactgaaggttattattcttctggttctgctactgttaatgttggtggttctactactggtggtaacaacggtggaaacaatggcggtaacaatggtggcaacaacggaggcaatactggttctaacgtttctatttctagaccaagaaaaatgggttctttggcttctactagatcataa

SEQ ID NO: 14 - DNA, 672 bp, Trichoderma reesei (synthetic version)
atggtttccttcacttctttgttggctggtgttgctgctatttctggtgttttggctgctccagctgctgaagttgaatctgttgctgttgaaaagagacaaactattcaaccaggtactggttacaacaatggttactttcattcttattggaatgatggtcatggtggtgttacttatactaatggtccaggtggtcaattttctgttaattggtctaattctggtaattttgttggtggtaaaggttggcaaccaggtacaaaaaacaaggttattaacttctctggttcttacaatccaaatggtaactcttatttgtctgtttatggttggtctagaaatccattgattgaatactacatcgttggtaattttggtacttacaatccttctactggtgctactaaattgggtgaagttacttctgatggttctgtttatgatatctacagaacccaaagagttaatcaaccatccattattggtactgctactttttatcaatactggtccgttagaagaaatcatagatcatctggttctgttaatactgctaatcattttaatgcttgggctcaacaaggtttgactttgggtactatggattatcaaattgttgcagttgaaggttatttttcttctggttctgcttctattactgtttcttaa

SEQ ID NO: 15 - DNA, 672 bp, Trichoderma reesei (native version)
atggtctccttcacctccctcctcgccggcgtcgccgccatctcgggcgtcttggccgctcccgccgccgaggtcgaacccgtggctgtggagaagcgccagacgattcagcccggcacgggctacaacaacggctacttccactcgtactggaacgatggccacggcggcgtgacgtacaccaatggtcccggcgggcagttctccgtcaactggtccaactcgggcaactttgtcggcggcaagggatggcagcccggcaccaagaacaaggtcatcaacttctcgggcagctacaaccccaacggcaacagctacctctccgtgtacggctggtcccgcaaccccctgatcgagtactacatcgtcgggaactttggcacctacaacccgtccacgggcgccaccaagctgggcgaggtcacctccgacggcagcgtctacgacatttaccgcacgcagcgcgtcaaccagccgtccatcatcggcaccgccaccttttaccagtactggtccgtccgccgcaaccaccgctcgagcggctccgtcaacacggcgaaccacttcaacgcgtgggctcagcaaggcctgacgctcgggacgatggattaccagattgttgccgtggagggttactttagctctggctctgcttccatcaccgtcagctaa

SEQ ID NO: 16 - DNA, 1152 bp, Chrysosporium lucknowense
atgaggaccttgacttttgttttggctgctgctccagttgctgttttggctcaatctccattgtggggtcaatgtggtggtcaaggttggactggtccaactacttgtgtttctggtgctgtttgtcaatttgttaacgattggtactctcaatgtgttccaggttcttctaatccaccaactggtactacatcttctactactggttctactccagctccaactggtggtggtggttctggtactggtttgcatgataagtttaaagctaaaggcaaattgtatttcggtactgaaattgatcattaccacttgaacaacaatgctttgactaacattgttaagaaggattttggtcaagttactgaaaattctttgaaatgggatgctactgaaccatctagaaatcaatttaacttcgctaatgctgatgctgttgttaattttgctcaagctaacggtaaattgattagaggtcatactttgttgtggcattctcaattgccacaatgggttcaaaacattaacgatagaaacactttgacacaagttattgaaaaccatgttactactttggttacaagatacaagggtaagattttgcattgggatgttgttaatgaaattttcgctgaagatggttctttgagagattctgttttctctagagttttgggtgaagattttgttggtattgcttttagagctgctagagcagctgatccaaatgctaaattgtacatcaacgattacaatttggatattgctaattacgctaaagttactagaggtatggttgaaaaagttaacaaatggattgctcaaggtattccaattgatggtattggtactcaatgtcatttggctggtccaggtggttggaatactgctgctggtgttccagatgctttgaaagctttagctgctgctaatgttaaagaaattgccattaccgaattggatattgccggtgcttctgctaatgattatttgactgttatgaacgcttgtttgcaagtttctaagtgtgttggtattactgtttggggtgtttctgataaagattcttggagatcatcttctaatcctttgttgttcgattctaattatcaaccaaaagctgcttacaatgcattgattaacgctttgtaa

SEQ ID NO: 17 - DNA, 1086 bp, Aureobasidium pullulans
atgcacttctctactattactgctgctttggctttgttgggtttgggtgctgctactccaactgattattctacttcttcctactctaaaaatcaaggtttggctcaagcttggacttctaaaggtagacaatatattggtactgctttgactattagagatgatccagttgaacaaggtattattcaatctagaaccgatttcaattctattactccagaaaatgctatgaaatgggaatctactgaaccacaaagaaacaattttacttttgctggtgctgatgctgttgctgattttgctgacagatacaacaaagaaatgagatgtcatactttggtttggcattctcaattgccagcttgggtttctcaaggtaattttgataacaagaccttgatttccattatggaaaaccatattaagaaagttgctggtaggtataaaaacaaatgtacccattgggatgttgttaatgaagctttgaatgaagatggtacttatagatcctctgttttctacaatactattggtgaagcttttattccaattgctttcagatttgctgaaaaatatgctggttctaagactaaattgtactacaacgactacaatttggaatatggttctgctaaagctttgggtgctcaaagaattttgaagttggttcaatcttatggtgttcaaattgatggtgttggtttgcaagctcatttgtcatctgaagctactgcttctactggtggtggtgttactccagatgttcaaactttgactaacgttttgaagttgtatactgatttgggtgttgaagttgcttatacagaattggatgttagatttactactccagctactgatgctaaattgaaagctcaagctgatgcttatgctagagttgttcaatcttgtatcaacgttaaaagatgtgttggtattactgtttggggtgtttctgataagtattcttggattccaggtgtttttccaactgaaggtgctgctttgttgtgggatgaaaatttcaacaaaaagccagcttattcttctgttttgaaaaccattcaatctttcagaaagtcctaa

SEQ ID NO: 18 - DNA, 1074 bp, Streptomyces avermitilis
atgccccacacaacagccgcccaccgtcgtcgcgcctcccgtcccctccccctcgtagccgtcggcgcgctggtcgccgccgccgtcgccctcccccagctcaccccggacgcctttgccgccaccaccctccggggctacgccgacggccgcggcgtgcggatcggtgcggccgtcggcgacagcccgttgcggagcgactcggcgtacaccaccgcgctggaccgggagttcaactccgtcaccgccgagaacgcgatgaagtgggacgcggtggagcccagccggggcggcttcgactgggccgccgccgaccggctcgtcgcgcacgcgagcgcacacggccagggagtacgcgggcacaccctggcctggtacgcacagctgccgtcgtggctgaagaacggcaacttctcggcctccgagctgaacacgatcctcaagagccacatcgacaccgaggtcggccgctacaagggcaaggtgtacgcctgggacgtggtcaacgagacgttcaacgaggacggctcgatgcgcggttcgctgtggcaggacaagctcgggaccgggtacatcgcgaacgcgctgcggtgggcgcacgccgccgaccccgccgccaagctgtacatcaacgactacaacatcgaggcggacaacgcgaagagcgacgccctgtacgcgctggcgaagcaactcctggcggacggggtgccgttgcacggcatagggttccagtcccacttcgtggtcgggcaggtgccgtccaccatgaaggccaatctcaagcgcttctcggacctggggctcgaggtctccgtcaccgaactcgacatccgcatccccctgcccgcctcctccgacgaactggctcagcagtccgccgactacaagacggccagcgagaactgcctgggtgtcgcgcgctgcgcgggcatcaccgtgtggggcgtcagcgacaagtactcatggatcccggggacgttcagcgggtacggcgcggccctcccgtacaacgagagctacgcggcgaagcccgcctacaccgggctgtcgaacggactcgatccgaccgcg

SEQ ID NO: 19 - DNA, 1353 bp, Streptomyces avermitilis
atgagatctctgaaaagatcaggcttatccccggcgtccttgctcaccggcatcgcggccctggccgccctgctggccgcggcccccgccgcgcacgccgccgacacgccgctccgtgacctcgccgccgccaagggcaaggtcatcggtaccgcggtcaccggctccaagctgaccggcacgtacggcgacatcgccggggcccagttcaactcgctgacccccggcaacgccatgaagtggggctcggtcgagcccacccagggcacgtacaactggaccgaggccgaccagatcgtcgccttcgcgcaggcccacaaccagcaggtacgcgggcacaccctggtctggcacagccagaacccgagctggctgacgaacggcacctggaccccggcccagctcggcacgctgctccagaaccacatcaccaccgaagtcacccgctaccagggcaagctggcggcctgggacgtggtgaacgagccgttcaacgaggacggcacctaccgctcgaccctctggtacaacggcctcggctccgattacatcgcccaggccctgaccgcggcgcgcgcggcggacccgagcgcgaagctctacatcaacgactacaacgtcgagggcgtcaacgcgaagagcaccgcgctctacaacctggtcaagtccctcaaggaccgcggggttccgatcgacggggtcggcctccaggcccacctcgtgctcggccaggtgccgtccacgctccagcagaacatccagcgcttcgccgacctcggggtggacgtggcgatcacggagctggacatccgtatgcagctgcccgccacggacgcgaagctgacgcagcaggcggccgactacaaggccgtgctggacgcgtgcgtggcggtgacccggtgcgtcggcgtcaccgtctggggcttcacggactccgactcctggatcccggacgtcttctccggctacggcgcggcgacgccgtacgacgagaactacgcgccgaaaccggcgtaccacgcgatcgcgacggcactcgggggcacctcgacaccgcccacgggcgcgtgcacggcgacgtacagcgtcacgagccagtggaacgcgggcttcacgggccaggtgcggatcgcctgttccggggcctccctgtcggcgtggaaggtgagctggacgtacggcgcgggccagcagatcacgcaggcgtggaacgcgacgtgcacccagtcggggacggcggtgagttgcgcgaacgcctcctacaacggcaccgtcccgaacggcggttcggtcaccttcggcttcaacgcgtcatggagcggaagcaacccgctgccgacagtgacgctgggg

SEQ ID NO: 20 - DNA, 1308 bp, Streptomyces avermitilis
atgatcctcacctccgacctgggcgacggcacctaccgcacccccgtcctgaacgccgactggtccgaccccgaccttctccgcgtcggtgacgacttctacctcaccgcctccagcttcggccgggccccgggcctgcccctgccgcactcccgcgacctcgtcaactggaggctcgtcggccatgcgctcccgcgcctcgaaccggcgcacgagttccggaccccgcgtcacgactgcggagtgtgggcgccctccctgcgccaccactacggctggctctggatctccgcgcccgccgggggagtgcagaccggctggcagggcgccttccgctcgcccggcttcttcgggccgtacgaggagcggatcgtgctggagcagggcgacaccgacgtcgacggaccgcaccagggcggctgggtgcgcaccccggccggcgaggactggttcgcgcacttccaggcgcggggcgcgtacgggcgggtcgtccacctccagctgatgcgccggggctcggacggctggccggtgatcgggaatgagggcgtccccgtggccgtacacaggaagccggacctgccgcggcagccgccctccgcgcccgccaccgacgacgacttccccggcggccggttcgggcgtcagtggcagtggaccgccaaccctctccccagctctcggctgcgctcgagcaggggtgacccccatgacggctgggccacccagctctccggcgacgggctgcgactgacctgcgtgcgcaccgccgacgcgcacgacctgcgcaagctcccgaacgtgctcacccagcggctgcccggcgcgcccgccaccgtcgaggtggagctgcggctggacagcgaggaacccggggcccgggccggactggcggtgctgggcgacgcgttcagctggatcgggctccaacgcggcagggacggctcggtccagctggtgcaccggttcgacgaatccgtcgccatgggggcaccccccacaccttcggggcagtgggggaaggagcgggacgccgcgcacgcgcggctcgcgcccggcgggcgggcccggctgtggatcgagatcggcaggggagcgcgctgccgcttctcgtacgacaccggggacggccgtcggccctccggcccggtcttcgccgccaccccctggcgctgggtcggcgccctgatcgggctcgtcgcgctcgcgcccgtcggcgcgggccacgccggcgcggccacgttcacccggttccgcggcaccgccgccggctccgcctccctctctgcccccgcctccacctcggcc

SEQ ID NO: 21 - DNA, 2205 bp, Streptomyces avermitilis
atgcgccgcaccgcccgcacactcctggtgcctctcctcgctctgctgctgggcctgctcgccgcgccgcccagccccgccgcacagtccggagcaccccacgtgaacgccgccaagtacgccggctatctcttcgcctacttcaccggggagggcaccgccgacggcgagcagatccgctacgccctcagccgcggcaacgacccgttgcactggcgggagttgaacgcgggaaagcccgtcctcacctcggacctgggcgagaaggggctgcgcgacccgttcgtgatccgctcccccaagggtgacaagttcttcctgatcgcgaccgacctgaagatgtaccggaacagcagcggcagctgggaccaggtccagcggcacggcagcaggtccatcatgatctgggagtccaccgatctggtccactggaccgaccagcggctggtgcgggtcgcccccggcaacgcgggcaacacctgggcgccggaggcctattgggacgacacgctgggcgcgtacgtcgtcttctgggcgtcgaagctctacgcggacgacgaccccgaccacacgggctcgacgtacaacaagatgctgtacgcgaccacgaaggacttccgcaccttcagcgagccgaaggtctgggacgacccgggctactcggtgatcgactcgaccgtcatcaagcacaagggcagttactaccgctacaccaaggacgagcgcgacccgagctcgtccagcccctgttcgaagttcatcaccggcgagaagtcgacgtcgctcacggacccgacgtacgacttcgtctccgactgcatcggcagcggttcgatcgaccggggtgagggccccacggtcttcaagtccaacaccgagaacaagtggtacctgttcatcgacgagtacggcggccgcggttacgtccccttcgagacgaccgacctcgactcgggcgagtggaccatgtcgacggactaccagctgcccgcgagcccgcggcacgggacggtcatgcccgtgacgcgggccgagtacgaccggctcctggccgcgtacccggtgagcggcacctcggtggtggacgcgacggcgaaggggcagaaggggtacgcggtcgtctccgaggacaccgcgaaggtcgtgctgccgatgaagccggacgcggacctgcggagactggccccggccctggccgtcggcgcgggcgcgaccctgagcccgcgctccggtacgcggcgcgatttccgcaggccgcagacgtacacggtgacggcggcggacggcacgaggcgcacctggaccgtcgaggcggtaccgacccgcagcccggtcctgcccgggctgtacgcggaccccgacatccagtacctggacggccgttactggatctacccgaccacggacggcttccccggctggagcggcacacggttcaaggcgttctcgtcgaaggacctggtccactggaaggaccacggcgtgatcctcgacctggggcctgatgtgacgtgggcggacaagaacgcctgggccccggcgatcgccgagcgcgacgggaagtactacttctacttctgcgcggagcagcagatcggcgtggcggtggccgactccccggcgggccccttcaaggacgcactgggcaagcccctggtcgccaaggggaagttggcgggccagatgatcgacccggcggtgttcacggacgacgacggcacgtcgtatctctactggggcaacggacacgggtacgtcgtgccgctgaacgacgacatggtgtcgtacgacgcgacgaaggtgaaggacatcacccagccggacttccgcgagggatccttcgtggtcgagcggcaggggacgtactacttcatgtggtccgaggacgacaccggcagcgagaactaccacgtctcctacgcgaccggaccgtccccgctcggcccgtggaccaagcggggcacgatcctgtccaagcgccccgagtacggcatcaaggggaccggtcaccactcggtggtgaacgtgcccggcacggacgactggtacatcgtctaccaccggttcgccctgagcggtcccgggaaggcgggcggggacggcacgcaccgggagacgaccatcgaccggatgaccttcgcggccgacggaacgatcgagccggtgacaccgacgctggagtcggtcaggcccgtgcgcgcaaac

SEQ ID NO: 22 - DNA, 1266 bp, Bacillus subtilis
atgattccacgcataaaaaaaacaatttgtgtactattagtatgtttcactatgctgtcagtcatgttagggccaggcgctactgaagttttggcagcaagtgatgtaacagttaatgtatctgcagagaaacaagtgattcgcggttttggagggatgaatcatccggcttgggctggggatcttacagcagctcaaagagaaactgcttttggcaatggacagaaccagttaggattttcaatcttaagaattcatgtagatgaaaatcgaaataattggtataaagaggtggagactgcaaagagtgcggtcaaacacggagcaatcgtttttgcttctccttggaatcctccaagtgatatggttgagacctttaatcggaatggtgacacatcggctaaacggctgaaatacaacaagtacgcagcatacgcgcagcatcttaacgattttgttaccttcatgaagaataatggtgtgaatctttacgcgatttcggtccaaaacgagcctgattacgctcacgagtggacgtggtggacgccgcaagaaatacttcgctttatgagagaaaacgccggctcgatcaatgcccgcgtcattgcgcctgagtcatttcaatacttgaagaatttgtcggacccgatcttgaacgatccgcaggctcttgccaatatggatattctcggaactcacctgtacggcacccaggtcagccaattcccttatcctcttttcaaacaaaaaggagcggggaaggacctttggatgacggaagtatactatccaaacagtgataccaactcggcggatcgatggcctgaggcattggatgtttcacagcatattcacaatgcgatggtagagggggactttcaagcttatgtatggtggtacatccgaagatcatatggacctatgaaagaagatggtacgatcagcaaacgcggctacaatatggctcatttctcaaagtttgtgcgtcccggctatgtaaggattgatgcaacgaaaaaccctaatgcgaacgtttacgtgtcagcctataaaggtgacaacaaggtcgttattgttgccatcaataaaagcaacacaggagtcaaccaaaactttgttttgcagaatggatctgcttcaaacgtatctagatggatcacgagcagcagcagcaatctacaacctggaacgaatctcactgtatcaggcaatcatttttgggctcatcttccagctcaaagcgtgacaacatttgttgtaaatcgt

SEQ ID NO: 23 - DNA, 1539 bp, Bacillus subtilis
atgaggaaaaagtgtagcgtatgtttatggattctagttttattattgagctgcttatctgggaagtctgcgtatgctgccactagtactacaattgcaaaacatatagggaattcaaatccgcttatcgaccatcatttgggagcggatccggttgcgctgacctataacggaagagtctacatctatatgtcaagtgatgactatgaatataatagcaacggaacaattaaagataattcatttgccaatttgaatagagtattcgtcatatcttcagcggatatggtgaactggacagaccacggagccattccggtagcaggtgccaatggagctaatggaggccgtggaattgcaaaatgggcaggtgcgtcatgggcaccgtcaatcgcagttaaaaaaattaatggcaaggataaattcttcctttatttcgcaaacagcggcggaggtatcggggttctcaccgcagacagcccgattggtccatggaccgacccaatcggaaaaccgctcgtaacgccaagtacgccaggaatgtctggtgttgtatggctttttgatccggcagtatttgtagatgacgacggaaccggttacctgtatgccggcggaggcgttcctggcgtttcaaatccaacgcagggacaatgggccaatcctaaaacggctagagtcataaaattggggcctgatatgacgagtgttgttggaagtgcatctacaattgatgcgcctttcatgtttgaagattcgggattgcacaagtataacggaacatattattactcctattgcatcaatttcggcggcacgcacccggccgataaacccccgggtgagatcggctacatgaccagttcaagtcccatgggtccctttacatatagagggcacttcctgaaaaatccgggtgcatttttcggaggtggcggaaacaaccatcatgctgttttcaattttaaaaacgagtggtatgtggtgtaccatgcgcaaactgtcagttccgctctgttcggggccggcaaaggataccgctctccccatattaataagctggtgcataatgcagatggatctattcaagaggtagcggcaaattatgcaggtgtaacacaaatttccaatttaaacccatataaccgggtagaagctgaaacgtttgcttggaatggacgcattttgacagagaagtccacagcacccggcgggccagtaaataatcagcatgtaacaagcattcaaaatggagactggattgctgtaggaaatgcagacttcggagcgggcggtgccaggtcatttaaagcaaatgtagcatccactttaggcgggaaaatagaagtgcgcctcgacagtgcagacggtaagcttgttggaactctgaatgtgccttcaacaggcggagcgcaaacgtggagggaaatagaaactgcggtaagcggggcaaccggtgtgcacaaagtattctttgtatttaccggaacaggtacaggaaacttgtttaattttgattactggcagtttacgcaaaga

SEQ ID NO: 24 - DNA, 639 bp, Bacillus subtilis
atgtttaagtttaaaaagaatttcttagttggattatcggcagctttaatgagtattagcttgttttcggcaaccgcctctgcagctagcacagactactggcaaaattggactgatgggggcggtatagtaaacgctgtcaatgggtctggcgggaattacagtgttaattggtctaataccggaaattttgttgttggtaaaggttggactacaggttcgccatttaggacgataaactataatgccggagtttgggcgccgaatggcaatggatatttaactttatatggttggacgagatcacctctcatagaatattatgtagtggattcatggggtacttatagacctactggaacgtataaaggtactgtaaaaagtgatgggggtacatatgacatatatacaactacacgttataacgcaccttccattgatggcgatcgcactacttttacgcagtactggagtgttcgccagtcgaagagaccaaccggaagcaacgctacaatcactttcagcaatcatgtgaacgcatggaagagccatggaatgaatctgggcagtaattgggcttaccaagtcatggcgacagaaggatatcaaagtagtggaagttctaacgtaacagtgtgg

SEQ ID NO: 25 - DNA, 1560 bp, Clostridium phytofermentans
atgctacaaaaaatgaacggaaaggttaaaaagattcttggaattagtatcgcatttcttatgttgatcatggtaattccaacatcaatcgcaaaagcagcaaccaataagacctatgattttaattcgatgacttatcaatccacatggggagttacatattctatcagtaatggatcaggaacatttaatttcactggtcaataccgtgaaattaagttcaatcttccggaaacgctagatatgtctcaatgtactagtgtaacattcaatgcttccagtccaaatggacagattgcatttaagctttacgatacttctggaaatcaggtggctgtagtgtataactttaattccaatacctcagactgtaccttcgcaccaaatagtacggcaaaggtaaacagtattggaataatggcgcaagggacaaataactactcagcagttgtgaatcgagttacatttacaatgacaggagggtcttctggcactggttcttcaactttattaaacacttatggaaatatattaaaaaactctggaactgctgttaatttaagtcagctgcaaaattcaaatacactaagtgtgattaagacgcaatataatagtatcacattagagaatgaaatgaagccagatgcagttcttggaagttcatcaacattaatgactgttgctcaagcaaaatcgaatggttattatattccttctagctacacggaaagtacagttccaactcttaaatttagtaccatcgatgcagttctacagatttgctacaataacgggctaaagcttagaggacatacattagtatggcattcccaaacaccggattggttctttagaacaggttatagttctagtggatcgtatgttagccaagctgttatggatgcaagaatggaaatgtttattaggtcttatatgagtcatatttataatggaagctatggaagtgtagtatatgcttgggatgttgtaaatgagtatttgcatgcttctacctctggatggtctcaagtttatggatccaaccttggtaccacaccatcttatgtaaagaaagctttccagtatgcgtatgattgtcttagcagttttggattaacgaattcagtaaaattgttttataatgattacaacacatatgaggttacagatcagatcctatcattagtaaattttattaactctggtacgaaactttgcgctggtgttggaatgcagtctcacttaaatacctcctatccttctgtatcggcatataaaacagctatgcagaagttcttgaatgcaggatatgaagtacaggttactgaacttgatgttacgaatacatcagcttccacacaagctacttatgtatatgatttgatgactgctattctttctctaaagaaagcaggtgggaatatcactggtattacatggtggggactatatgatagcgtatcttggcgtgcctcccaaaatcctttgttattcagtaatttaactactccaaaagaatcttataataaagcgttacaagcatttacagatgcaggatat

SEQ ID NO: 26 - DNA, 2268 bp, Clostridium phytofermentans
atgtttttcaagaaactagttgcactcgcaatggctgttgccattgtcattccaatgaacgttaataacatacaaaaggttgaggcggaatctacaaatgaagcagtagtatatggtaatctaatttatcacgactttgaagcaagcaccaatgggtggggaccaagaggtgacaatgcagaggttgtggcacaaagtacagaagaggcatattcagggttacatagtttaaaaattagcaaacgcacgcaaacatggcatggtgctacctgcgatttgacaaaggaacttacgattggagaaacttatgtatttggaatttatttaaaatataaaggtagctcttattccaatacacaaaagtttagcttacaatttcagtacaatgatggtgtgaatgatcagtacaaaacaattaagactttagaagtaaccaaagataaatggacattaattcaaggtgagtatacagttccagcagatgccgctaatgcaaaggtctatgtcgaaacagaatataagagttcaccatcaagtcaagatctcttagacttttacattgatgatttcactgcaacgccagcaactttaccacagattcaaaaagatattcctagtttaaaggatgtattttcaagttacttctttgttggtggagcggcaactgcaggtgagattgcaccagctccggcaaaagatttagtagcgaaacattacaataggttaactcctggtaatgagttaaaaccagactctgtattagattactctgcaaccatagcctatatggatgcaaatggtggtaatcaagtgaatcctcaggtgaatcttagagctgcgaaaactttactggaatatgcaagagacaataatataccagtgcgtggacataccttagtatggcatagccagacaccagattggttctttaaggtaaactattctcaggattcaaatgcagcgtgggtttccaaggaagtgatgctccaaagactagaaaactacatcaaaaatgtgatgcagctgatctcatcaacctatcctacagtaaagttctatgcttgggatgtggtgaatgaagcagtagatccaaatacttctacaggtatgagaaatcctggatcgaataacgtaacatctggtaattctccatggatgcaaaccataggtgaggaatatattcaaagagcttttgaatacgcaagaaaatatgctccaactggttgtaaactgttttataatgattataacgagtatgaggatagaaagagtacctttatctttaatatcctgaaaggattaaaagataagggcttagtggatggtatgggaatgcagtctcattgggttatggattatccaagtattagtatgtttgagacagctgttcgtaaatataatactttaggattagaattacaactaacggagttagatataaagcagccagacaatagtacatctgctttagctgctcaggcagacagatataaacttttgataaataaggtcattagtttgaaaaaagagggcatgaacattacaggagttatcttctggggtgtaacggataagactagttggttaggtggatatccattattatttgatggaaattatcaagcaaagtcagcatactattctatcattgatgggattaccccaacagtaacgccatcaataactccaactgtaacaccaaaaccaacgataacacctacagtaacaccaactgtaacgccaaaaccaacgataacacctacagtaacaccaactgtaacaccaaagccaacaataactcctaccataacaccaacagtaacgccaaaaccaacaatagctccgacaccaactcctactacagtaccagtggagggagcaaaaccggtggtagtagtaactacgaaaaacaatgggaacacgataagccagcaatacacaataaatgcacttggtggaacgattgatttgtcaaaggtatctattgagtttactgccgatggaatcatcaatcaagagcataatgtttgggtagataacgctgcgttgcaattaacagttgaaccatattacacaccgttaaatggttatgtttctgggcagttgacgaatcaaaaacttgtggttagcatcagtaagagtacgatgctgtcagaaggaacaggaaagcttgttcttgatttacgatttgctaagaaggattggacggattttggtacgatatccaatgaagtgttaaaggtttactataatggagtcaaagttcaa

SEQ ID NO: 27 - DNA, 636 bp, Clostridium phytofermentans
atgtttaaattaaataagaaagtttttgcattagtttctgtaattgcattaggtttttctagcttatttacatcaactgctcatgcagcaactgattactggcagaattggactgatggtggtggaacagtgaacgctaccaatggttctggtggtaactacagtgttaactggacgaattgtggtaattttgttgtaggtaaaggttggggtactggaaatgcatcaagagttgtaaattacaatgctggtgtattttcaccatctggtaatggttatttaactttctatggttggacgagaaattcactcattgaatattatgttgttgatagttggggtacttatagaccaactggaactttaaagggtacagtttctagcgatggtggaacatatgatatttatacaagtacgagaactaatgcaccttccatcgatggtactcagactttccaacaatactggagtgttagacagtctaagagagctaccggaagtaacgtagcaattacttttagtaaccatgttaatgcttggaagagtaaaggaatgaacttaggaagcagctgggcttatcaagcattatgcgtagaaggatatcaaagcagtggtagtgctaatgtaacggtttgg

SEQ ID NO: 28 - DNA, 2418 bp, Clostridium phytofermentans
atgggtaaaaaagtaatagctttattaacatgtgttatgctttcgcttacgctgattccgggtatcggcataaagagcactgcacaagccgctgaaaccaacatctataaagtagattggagcaaatttaatgagggtgacaaaatcagcggtcccatggagggtttaggtagatcaggcggagcagatatcacggttacgggctcctctaccaaatcattttacatatctaatcgtaaagataactgggatgcacttgatattcagaacgatcttttgaagttagatcgagatgcaacctatgaaatcacagttaccggtcatgttgacagcaatgtagatactaagaatgctagtgtcaagcttggcggtgtaacaaggaaaacgggcgaggatgatggatacccagagttcaaaaaagagaaactacaatcgggcaagagttttgtactaacctatgaacttaaactttctgatcaaattccggacgcttcaagaaatctgtgggtgctccgtgttcagaccgacgaaccaagcggaagtagggccggagatcttgtaccgttctatgtggatgatatcgtgattattcaaacaaaggcatccactgctcctgtagctgtgactggtgaccttatgtcactttacgaacttaatgcggacaaaactctcaaggttggagaatcattatcaagtccagctctgaaagtttctggtaatgctaagatagttgttgtagaaggcaccgatggtaccgtgtcattacaactgaaagaccgtgttaataattatgacggtgtagacatccttcgtgatgcactgaaaataaacgataaatttatgtctggtacatacacgattgaggtaaaaggccatgtagaggatggttctgatttaagtaaatcccagtttgttatgggtatgaccgaatctccatggggcgaactcacttcaagagtgacgccaagtagtgacggtagctttgtaataacttataccaaagcatacaccggaagtgaattgacaggcctaggttatagctaccgagttcagacacctccaagcgttctcacatcgttttatatcgataacattaccgttacggttcagggagctgaagaagaagatgagtcaactgtggttatacctgaatgggatttaacccttgattccattaaagatgcatacgctgattacttcatgataggtaatattatggaaccaggtcagatacaggatacagaaaccaccgaaatgtttaagcatcattataatgttgttaccgcagaaaatgccatgaaaccagggaatatttccaaggtaaaaggcgaatacaattttgacaatgctgataagcttgttacgtgggctaaagaaaatggtttaaaagtccacggtcatactttagtttggcactctcagtcagctccatggttgactacaaatgcggatggaacacctctaacacgtgcagaagcaagagctaatatggaagattatattaagaacgttgcaggacattacgcagggaaggtgatttcatgggatgtattaaatgaagcatttttgccaggtgtatccgaaatccctgctggctggagggatgtattacgcaaatttgaagataacggaaatggttctccttggtatcaagcctatgaaaacggtgctgataagagcaagggcgaggatggctctgattatatctatgacgctttcgtgtttacacgtcttgccgctcctgatgcagtgctgtattataacgacttcaatgagacagaggcaggtaagtgtgaagcgatcgccttgatggtggaagaattaaacacaaagtggaagaccgataaacggaacactgagcctgacagattgctcatcgaaggaatcggaatgcaggcacattattggaccggagatttaaaggtttccactgtagaagctagcatcaagcgtttcataaaaacaggtgctaagatcagtgtatctgagctggatgttcctcatggcgattacatgacctacaagcaacgtactgactctcctacaaaggaagaagagaaacttcaggcggatttatacaagcagttgtttgaagtatacaaaaaatatgcggacaacatcgaacgtgtcaccttctggggtaaaacagatcctcaaagctggcgtttccaaggttatccattactgtttgataaaaattttgctccaaaggacgcattctttgctgtaattgatgtagcaaaggaaaaggtagcagaggaaaaggctgttgaaaccatacctggtaaagatatcccgaaaacaggggaagacagcagtaagcaaatgattttgactgcagtagctattctgattatattggtattcgtaccagttacgatcttaacaaaacgaagagagaagaatataaagaatata

SEQ ID NO: 29 - DNA, 1143 bp, Clostridium phytofermentans
atgaatggtgcaataaaaagtgggtattaccggaatgtgtttaccgaattaggctataaagaagaggacgtaactaagaaagttgaggacagctttcagaccttgttctatggtctaccagaagaacgcatatattatcctgtgggtgaagatttaggatatatcgtggataccggaaatcatgatgttcgaacagaaggaatgtcttatggaatgatgatgtgtttgcaattagataaaaaagaggaatttgatcgcttatggaaatgggctaagacatatatgtttatggattctggtgttaacaaaggctattttgcttggtcatgtaaaacagatggtacgaaaaattcctatggaccagcaccggatggtgaggagtattttgctttagcattattctttgcttccaaccgctggggtgatggaaatggaattttcgaatatagtaaacaagcgagagaacttcttcatgaatgtatccataaaggagaagaggatggaatcggagaacctatgtgggagccatcgaactacctgataaaattcatacctaattgcaattttacagatccatcgtatcatttaccacacttttacgggttatttgcactttgggcatatgaagaagatagagaattctttaaaaaggcagcggaagcgagtcgttcgtatctaaaacttgcatgtcatgaaaagactgggctttgcgcagaatacacagagtacgatggaactgctcatagtggagatcaagaaatatttggacgccatgattggtattacagcgatgcttatcgaaccattgcaaacattggtcttgattatctctggtttgcagctgatgaatggcaagtaacatgcgctaatcatttacagcaattcttttgtgagacagtaaaagagcatgcaagtggtatttatcaagtagatggaacgataatcaagggcgaggctttacaccctgttgcaataatcgctaccaatgcgcaagcatctttagcagcaaatggtccctttgcgaaagaatgtgtcgacaagttttatcatacagaattaaggactggcgatagaagatattacgacaattgcttgtatatgtttgcactcttagctttaagtggaaagtatcgtatgtggatg

SEQ ID NO: 30 - DNA, 1185 bp, Thermobifida fusca
atgggtctccccgtctccgtccacaggagtgacacaaaaatgagggtgggccgatacatcgccatcacggttggggcctccgcgctgctcgtctccggggtggcgccggcggcggcgggtacgctgccgacgtccgggacggccgccggcgcggcgtcgcaggccgggcacgatcagaagcaggtaccgctccgcaaggtggcgccgaagggcttcgcgatcggcgtggccgtcgcgggtggtggccaccatctggaccaggagtacccggaccccttcaagtacgacgaggagtaccggggggtgctcgccaagcacttcaactcggtcactcccgagaaccacttgaagtgggacttcgtgcacccggagcggaaaaagtacaacttcgggcctgctgaccagatcgtcaagtttgcccagagcaacgggcagaaggtgcgcggccacacgctggtctggcacagccagaaccccgactggctcaccaaggggaagttcagcaagaaggagctccgcaagatcctcaaggagcacatcatcacggtggtgggccgctaccggggcaagatccaccagtgggacgtggccaacgagatcttcgacgacaacggtaagctccgcacgaacgagaacatctggctgaagaacttcgggccggagatcatcgccgacgcgttccgctgggcccaccaggccgacccgaaggcgaagctgttcctcaacgactacggcgccgagggcatcaacaagcgcagcgacgcctacctcaagttcatgaaggagctgcgcaagaagggcgtgccggtacacggcttcggcgtgcaggggcacctgagcctggcctacccgttcccgggcgacatggcgaagaacctcaagcggttctcggacgccgggttcgaggtcgcggtcaccgaggtcgacgtgcgcatcccgctcaacggcggcgacgccactgaagcccagctcaagacccaggccgactactaccgccgcgccctggaggcctgcctgagcgtcaagagctgcaactccttcaccctctggggcaccacgaacaagtactcgtgggtgccggtgttcttcccggacgagggcgaggcgacgatcttctgggacgacttctcccccaagcccgcgtacaccgccctgcaggaggccctggcgaaggcccgccgccgc

SEQ ID NO: 31 - DNA, 1014 bp, Thermobifida fusca
atgaaccatgcccccgccagtctgaagagccggagacgcttccggcccagactgctcatcggcaaggcgttcgccgcggcactcgtcgcggtcgtcacgatgatccccagtactgccgcccacgcggccgtgacctccaacgagaccgggtaccacgacgggtacttctactcgttctggaccgacgcgcccggaacggtctccatggagctgggccctggcggaaactacagcacctcctggcggaacaccgggaacttcgtcgccggtaagggatgggccaccggtggccgccggaccgtgacctactccgccagcttcaacccgtcgggtaacgcctacctgaccctctacgggtggacgcggaacccgctcgtggagtactacatcgtcgaaagctggggcacctaccggcccaccggtacctacatgggcacggtgaccaccgacggtggtacctacgacatctacaagaccacgcggtacaacgcgccctccatcgaaggcacccggaccttcgaccagtactggagcgtccgccagtccaagcggaccagcggtaccatcaccgcggggaaccacttcgacgcgtgggcccgccacggtatgcacctcggaacccacgactacatgatcatggcgaccgagggctaccagagcagcggatcctccaacgtgacgttgggcaccagcggcggtgacaaccccggtgggggcaacccccccggtggcggcaacccccccggtggcggtggctgcacggcgacgctgtccgcgggccagcagtggaacgaccgctacaacctcaacgtcaacgtcagcggctccaacaactggaccgtgaccgtgaacgttccgtggccggcgaggatcatcgccacctggaacatccacgccagctacccggactcccagaccttggttgcccggcctaacggcaacggcaacaactggggcatgacgatcatgcacaacggcaactggacgtggcccacggtgtcctgcagcgccaac

SEQ ID NO: 32 - DNA, 2280 bp, Clostridium thermocellum
atgattgtaggaaaagttcttgatatggatgaaaagacggccattataatgactgatgactttgcttttctgaatgtggtaaggacctctgaaatggcagttggtaaaaaagtgaaggttttggactcggatataatcaagcctaaaaattctttgcgcagatatttgccggttgcggcagttgctgcatgctttgtaattgtgttgtcttttgtgctgatgtttattaatggaaatacggcaagaaaaaatatatatgcttatgttggcattgatataaatccaagtattgagctttggataaattacaacaacaaaatagccgaagccaaagcactgaacggcgatgccgagacagtgctggaaggacttgaattaaaagaaaaaacagtggcggaggctgtgaatgagattgtgcaaaagagcatggagcttggatttatttccagggagaaggagaatataatccttatatccacagcctgtgatttaaaagcaggggaaggttcggagaataaggacgttcaaaataaaatcggtcagctttttgatgatgtgaacaaggcggtttcagaccttaaaaacagcggtattacaaccaggattttaaatcttactttggaggaaagagaatcatccaaagaagaaaatatttcaatgggcagatatgccgtgtatttaaaagccaaagagcagaatgtaaatttgactattgatgagattaaagatgcggatttgctggagctcattgccaaggtcggcattgataatgagaatgttccggaggatattgtaacagaggataaagacaacctggatgcgataaataccggacctgcggaaagtgccgtgcctgaagtgactgaaactttgcctgctacctcaacacccggcaggacggaaggtaacaccgcgacaggttcggttgacagtacacctgctttgtccaagaacgaaacaccgggcaaaacagaaacaccgggaaggacattcaatacaccggcaaaatcgtcactggggcaatcttcgacgcccaagccggtatcacccgttcaaacggcaacagcgacaaagggtattgggactttgacacccaggaactcaccgacgccagtaataccttccaccggcattcaatggattgaccaggcaaatgagagaataaatgagattcgaaagagaaatgtacagataaaagttgtggattccagcaacaagccgatagagaatgcttatgtggaggcggttctcaccaaccatgcctttggatttggtacagccattacaagaagggcaatgtacgattcgaattacactaagtttataaaagaccactttaactgggctgtgtttgaaaatgaatccaaatggtatacaaatgaacccagtatgggaattataacctatgacgatgctgactatttgtatgaattttgccggagcaacggaataaaagtgaggggacactgtattttctgggaggctgaagagtggcagcctgcatgggtaaggagtttggatccgtttaccctgcgttttgcggtagacaaccgcttaaacagtgctgtaggtcattttaaaggaaaattcgaacattgggatgtaaacaacgaaatgattcacggcaactttttcaagagccgtctgggtgagtccatctggccttatatgttcaacagggcaagagaaattgatccgaatgcaaagtattttgtaaacaacaatataaccactttgaaagaagcggatgattgtgtggccctggtaaactggctcagatcccagggagttcgtgtggacggcgtaggagtgcacggacactttggtgactcggtggaccgcaatcttctcaaaggaatacttgacaagctgtctgtcttgaaccttccgatatggattaccgaatatgattcggttacaccggatgaatacaggagggcggacaatctggagaacctctatcgtacggctttcagccatccttccgttgaaggaatcgtaatgtggggtttctgggaaagagtgcactggagaggaagagatgcgtcaatagtaaatgataactggacgttgaatgaagccggcagaaggtttgagtccttgatgaatgagtggactaccagggcttatggaagcacggatggttcgggcagctttggcttcagaggattctatggaacatacaggataaccgtgacagtgccgggaaaaggaaagtacaactatactttgaatctgaaccgcggcagcggaacattgcagactacttacagaattccc

SEQ ID NO: 33 - DNA, 1965 bp, Clostridium stercorarium
atgaagcgtaaggttaagaagatggcagctatggcaacgagtataattatggctatcatgatcatcctacatagtataccagtactcgccgggcgaataatttacgacaatgagacaggcacacatggaggctacgactatgagctctggaaagactacggaaatacgattatggaacttaacgacggtggtacttttagttgtcaatggagtaatatcggtaatgcactatttagaaaagggagaaaatttaattccgacaaaacctatcaagaattaggagatatagtagttgaatatggctgtgattacaatccaaacggaaattcctatttgtgtgtttacggttggacaagaaatccactggttgaatattacattgtagaaagctggggcagctggcgtccacctggagcaacacccaaaggaaccatcacagtggatggcggtacttatgaaatatatgaaactacccgggtaaatcagccttccatcgatggaactgcgacattccaacaatattggagtgttcgtacatccaagagaacaagcggaacaatatctgtcactgaacattttaaacagtgggaaagaatgggcatgcgaatgggtaagatgtatgaagttgctcttaccgttgaaggttatcagagcagtgggtacgctaatgtatacaagaatgaaatcagaataggtgcaaatccaactcctgccccatctcaaagcccaattagaagagatgcattttcaataatcgaagcggaagaatataacagcacaaattcctccactttacaagtgattggaacgccaaataatggcagaggaattggttatattgaaaatggtaataccgtaacttacagcaatatagattttggtagtggtgcaacagggttctctgcaactgttgcaacggaggttaatacctcaattcaaatccgttctgacagtcctaccggaactctacttggtaccttatatgtaagttctaccggcagctggaatacatatcaaaccgtatctacaaacatcagcaaaattaccggcgttcatgatattgtattggtattctcaggtccagtcaatgtggacaacttcatatttagcagaagttcaccagtgcctgcacctggtgataacacaagagacgcatattctatcattcaggccgaggattatgacagcagttatggccccaaccttcaaatctttagcttaccaggcggtggcagcgccattggctatattgaaaatggttattccactacctataataacgttaatttcgccaacggcttaagttctataacagcaagagttgccactcagatctcaacttccattcaggtgagagcaggaggagcaaccggtactttacttggtacaatatatgttccttcgacaaatagttgggattcttatcagaatgtaactgccaaccttagcaatattacaggtgtgcatgatattacccttgtcttttcaggaccagtgaatgtggactacttcgtatttacaccagcaaatgtaaattcagggcctacctcccctgtcggaggtacaagaagtgcattttccaatattcaagccgaagattatgacagcagttatggtcccaaccttcaaatctttagcttaccaggtggtggcagcgccattggctatattgaaaatggttattccactacctataaaaatattgattttggtgacggcgcaacgtccgtaacagcaagagtagctacccagaatgctactaccattcaggtaagattgggaagtccatcgggtacattacttggaacaatttacgtggggtccacaggaagctttgatacttatagggatgtatccgctaccattagtaatactgcgggtgtaaaagatattgttcttgtattctcaggtcctgttaatgttgactggtttgtattctcaaaattcaggaacttaagggtatag

SEQ ID NO: 34 - DNA, 1164 bp, Clostridium stercorarium
atgaataaattcttaaacaaaaaatggagcttaattttaaccatgggaggtatttttctgatggcgactttatcattgatttttgcaacggggaaaaaggcctttaacgatcaaacttctgctgaagacatcccatcgcttgctgaggctttcagagactattttccgattggagcggccattgagcctgggtataccacaggccaaatagccgaactgtataagaaacacgtgaacatgctcgtggcggaaaatgcaatgaaaccggcgtcacttcagccgacggaaggtaattttcagtgggcagacgctgacagaattgtgcagtttgcgaaagaaaacggtatggaactgcgcttccacactcttgtgtggcataatcagacgccgactggtttttccttggataaagaaggaaaaccaatggtggaggagactgatccacagaagcgtgaagaaaacaggaaacttctgctgcaacggcttgagaattatattcgtgctgtggttttacgctacaaagacgacataaagtcatgggatgtggtgaatgaggtaattgaacccaatgatcccggcggtatgagaaacagtccttggtatcagattaccggtaccgagtacatcgaagtggcattccgtgcggcaagggaagcgggaggatccgatattaagctttatatcaacgattacaatacagatgaccctgtcaagagagatatactgtatgaattagtgaaaaatttgctggagaagggtgtgccgattgacggggtgggacatcagacacatattgatatttacaatccgcctgtcgagcgaataatagagtctataaaaaaatttgccggactgggactggacaacataattaccgaactggacatgagcatatattcatggaatgaccgcagcgattacggcgatagtatacccgattatatcctgactttacaggccaaacgttatcaggaactgtttgatgcgttaaaggaaaataaggacattgtaagcgcagtggtgttttggggcatttcggacaaatattcctggttgaacgggtttcctgtaaaacgtaccaatgccccgctgctgttcgacagaaatttcatgccgaaaccagctttctgggcgatagttgatccttcacggttgcgggaataa

SEQ ID NO: 35 - DNA, 3099 bp, Clostridium stercorarium
atgaatggccgtaatgggggtaaaagacctatagcgagcctgcttgtgctcacacttgcatttttattcattccggtaacgaaggcagaaacaacggtttatcatgagacttttgccgaaggaaagggagcggcggtacagtcaggcggggcgaccattacgcacgttaccggaaaattttttgacggcaacggggacggagcggcactgtacatatccaacagagtgaacaactgggacgctgcagatttcagattcagcgacataggtcttcaggacggaagaatttataaaataacggtaaagggatatgtggatcccgatgttcatgtaccggagggttcccagatatggcttcagaccgttaacagctatgggtggtggggcagtaccgacataaaggccggtgaagcctttactctgacgggcgtatataaggtggatacaaccaatgattatgctctgaggattcagtccaatgacaccggagcatttgttccgttttatatcggtgaaatattgatcaccgaagaaacggttcctcaggatgacagccgaaatgggaataaaactcatgctgagaagttcacacccataacctttgaggaccaaaccacaggcggatttacaggcagggcaggaaccgaaattcttacggtaaccgatgaggcaaaccataccgatggcggaagatattcgcttaaagtcgggggaaggaacgacacatggcatggcccggcgttgggtgtggaaaaatacgtggatcagggttacgaatataaagtggcggtttatgtcaggctgatttcacctgaaagtgcacaactgcaactgtcaacgcaaattggtgaaggcacatcggcaagttacgtaaaccttgcgaaaaagaatgttgcaatcagtgacggctgggttctgctggaaggtacataccgctacgacaatcttggcggagggtacctgacaatatatgtggagagccctgacagccctgaggcatcattttatattgacgacatcaactttgaacccacgggcatgaaatctgaagagattgaaaaaggtttaaaatccttgaaggatgtgtataaggataattttctcaccggcacggcgatatcattgcgtgacctggaaggtgtaaggtttgagcttctgaaaaaacatttcaatgcggtaactgcggaaaatgcaatgaagccttccgaattgcagcgtgagaagggaaattttacctttgacggggcagacaggcttgtaaacgccgcaataagtgcaggaatgaaagtacacgggcatacgctggtatggcaccagcagacccccgcgtggatgaatattaagttggatagcggaggaaatattgtatacctcagcagggaagaagcgcttgaaaatatgagaaatcatataagaaccgttattgagcattttggcgacaaggttatatcgtgggatgttgtaaacgaagcaatgagcgacaatccttccaatccttccgactggagaggatcactgcgtaaatcgccttggtattatgccattggcgaagactacgtggaacaggctttccttgccgcgagagaggtgctggatgaacaccccgaatgggatattaagctttactacaacgattacaaccttgataaccagaacaaagctttggctgtttacaacatggtaagagaacttaacgaaaaataccagaaaactcatccgggaaaactccttatcgacggtataggcatgcagggacattattctgtaaatacaaatccgaagaatgttgaactgtcactgaagcggtttaccgaactgggtgtggaggtcagcataagcgaactggatatccgtgcgggcagcaattatcagctcaccgagaaagaggcgaatgcccaggcctacctttacgctcagttgttcaaaattttccgtgaatattccgacagtattgcacgggttacgttctggggaatggatgacggtacaagctggagggcggaagaaagcccgctgctgtttgacaggaccctaaaagccaaacctgcgtattacgctgttgcagatccggacgaattcattgagaaatataagcctgaaacaatagaagccaaccgggcatatgcggtttacggcacacctgaaattgacggaaaaaccgatgaagtttggaacaaggcacctgagctgaaaattaacaggtaccagaccgcttggcatggcgccgacggcaccgcaagggttctttacgacgaaaacaacctgtacgttctgatcaaggttaatgacacacagcttgataaaggaagcccaaatccatgggagcaggattcggttgaaatatttatagacgaaaataatgcaaaaacatcattttatgaggaagacgacggccagtacagggttaactttgaaaacgagacatcctttaatccggaaagtatagccggcggttttgaatcggccgcggaagtttcgggaacaaactataccttggaagtgaaaataccgttcaggaccgtgaaacccgtcagcaatatgcaaatcggatttgacgtgcagattaacgacggaaaaaacggagtgcggcagagcattgcaacatggaatgacccgactggaaatgcatggcaggatacttcggttttcggtattcttactttgaaatcaaaaaatccggttacccgcggtgaagccattgtaaaaattatgaaggcttatgatatggaaccactggaaaactggaacgacaatttctccgatgcttcgggaagctacgcgggatattacccgagagcaaaggaaacgggttttgtcagcggtatcggggacaataagataggtgctgaaattccgcttacccgggaaatgttttttacaatgatttataatatcgaacgaataacagggaaaatgcaggggatagatatttcagacgcggaacttacacttttcagcgattataacgacttgtcggagtgggccgaagaggcagttaaggcattggttaaatcaggcaggatcaaaattaacggcgatttattgccgaagcggcttatggacgctgaagaagtggaggcatttttaagattaagataa

SEQ ID NO: 36 - DNA, 2067 bp, Anaerocellum thermophilum
gtgagtgtttgtctttataaaaggttgaaaaggttttcagtattgattttagtaattttatttttgattgtaaccttaattggtatagaaactactaaaactagtagagtcattggagaaacaaaaaagagttttgtggagtataattttgaaaataggtttatagcaccatttaaagcgtcaggaaaatctatgagtttaaggattgacaatacaacagcagcagaagggaccttttcacttcttgcaagtggccgaaagcaaatagatgatggaattttgcttgatgtaaccaatcttatagattatgcaaatgaatataaaattactctatatgtttatcacaagtcaagcaaaatgcagcgttttgttgtgagtagcgaaattgagacaaaaagcggaaagaaaacaaaactgctgtgtgaaaaaattattattccaaaaagttggaaaaaacttgatgcaaatttaaatttgactgagcaaaaagggataaaaaaagtttggctaaaggtatatgtgccaacctcaaccacaaatttttacgttgacctttttacactcaaagttgctgacaaatctcatctaataaaatttgaaaactttgaagataaaagtatagcaggatttatctctcaagataaaaaatgtaaattatccatttcaaaagaaaaagcttaccaaggtacatatagcataaaagttcagcaaacagttaaaagacaaaacacaacagttatcttgcctgtaaaaggaacatttgaaaaggggaaaagttattcaatatctttttatatgcatcaatccattctaaagagtttaaattttgcagttggtataaggtttctggaaagtggaaagaatatgagagagattgtgcttgggagggtaaccattccaaagaataagtggacagaagtatttgcaagttatacgccctctttggattcaaagataaaagactttgtgattttcataagacccctctcagatatttcctattactatatcgacaactttacaatttcagatgatggatggtattcagctgtacctgatttagatttaccttctttgagagagaaatacaaaaactactttaaaattggtgttgctgtaccatacagggctttgacaaatccagttgatgttgctttcataaagagacattttaacagcattacagcagagaatgagatgaagccagaagcacttgaaccaatagaggacaatttcaacttttcaattgctgatgagtatcttaatttctgcagaaagaataatatagctattcgtggtcacaacttgttgcatcagcaaaccccaaactggttttttgaaaaccctcagacagggaaaaagctgacgaatagtgaaaaagacaaaaagatacttttagagaggctaaaaaagtatatccagacagttgtttcaagatacaaggggagaatatatgcatgggatgtggtaaatgaagctattgatgagaatgagccagatggatttagaagaagtgactggtttaatgtattgggtccagagtatatcgaaaaagcgttcatatacgctcatcaggcagaccctaacgctcagcttttttacaatgactacagcacagaaaatccagtaaagagagaatatatttacaagctaataaagagtctaagagaaaaaggaatacccattcatggtgttggtcttcagtgtcatatttctgtaagctggccaagcgttgaagaggtagaaaaaactataaaactttttagcagcattcctggtattaagatacatgtcacagaaattgatataagtgtggcaaaagaatatggtgaagacatagatgaagaaacaaaaagatatcttttgattcagcaggcaagaaagttaaaagatctttttgatgtgttcaaaaaatacaaaaatgtagtaacaagtgtttcgttctggggactcaaagatgactattcatggcttcaaggtgattttccacttttgtttgacaaagattatcaaccaaaatttgctttctggagcttaatagacccgtcagttgtgccagaagaataa

SEQ ID NO: 37 - protein, 327 aa, Aspergillus niger [sequence omitted]

SEQ ID NO: 38 - protein, 225 aa, Aspergillus niger
MLTKNLLLCFAAAKAVLAVPHDSVVERSDALHKLSERSTPSSTGENNGFYYSFWTDGGGDVTYTNGDAGSYTVEWSNVGNFVGGKGWNPGSAQDITYSGTFTPSGNGYLSVYGWTTDPLIEYYIVESYGDYNPGSGGTYKGTVTSDGSVYDIYTATRTNAASIQGTATFTQYWSVRQNKRVGGTVTTSNHFNAWAKLGMNLGTHNYQIVATEGYQSSGSSSITVQ

SEQ ID NO: 39 - protein, 261 aa, Chaetomium thermophilum
MVNFSTLFLAASTAALAAAAPSIEKRQTLTSSATGTHNGYYYSFWTDGQGNIRFNLESGGQYSVTWSGNGNWVGGKGWNPGTDNRVINYTADYRPNGNSYLAVYGWTRNPLIEYYVVESFGTYDPSTGATRMGSVTTDGGTYNIYRTQRVNAPSIEGTKTFYQYWSVRTSKRTGGTVTMANHFNAWRQAGLQLGSHDYQIVATEGYYSSGSATVNVGGSTTGGNNGGNNGGNNGGNNGGNTGSNVSISRPRKMGSLASTRS

SEQ ID NO: 40 - protein, 229 aa, Trichoderma reesei (synthetic version)
MVAFSSLICALTSIASTLAMPTGLEPESSVNVTERGMYDFVLGAHNDHRRRASINYDQNYQTGGQVSYSPSNTGFSVNWNTQDDFVVGVGWTTGSSAPINFGGSFSVNSGTGLLSVYGWSTNPLVEYYIMEDNHNYPAQGTVKGTVTSDGATYTIWENTRVNEPSIQGTATFNQYISVRNSPRTSGTVTVQNHFNAWASLGLHLGQMNYQVVAVEGWGGSGSASQSVSN

SEQ ID NO: 41 - protein, 229 aa, Trichoderma reesei (native version); identical to SEQ ID NO: 40

SEQ ID NO: 42 - protein, 383 aa, Chrysosporium lucknowense
MRTLTFVLAAAPVAVLAQSPLWGQCGGQGWTGPTTCVSGAVCQFVNDWYSQCVPGSSNPPTGTTSSTTGSTPAPTGGGGSGTGLHDKFKAKGKLYFGTEIDHYHLNNNALTNIVKKDFGQVTENSLKWDATEPSRNQFNFANADAVVNFAQANGKLIRGHTLLWHSQLPQWVQNINDRNTLTQVIENHVTTLVTRYKGKILHWDVVNEIFAEDGSLRDSVFSRVLGEDFVGIAFRAARAADPNAKLYINDYNLDIANYAKVTRGMVEKVNKWIAQGIPIDGIGTQCHLAGPGGWNTAAGVPDALKALAAANVKEIAITELDIAGASANDYLTVMNACLQVSKCVGITVWGVSDKDSWRSSSNPLLFDSNYQPKAAYNALINAL

SEQ ID NO: 43 - protein, 361 aa, Aureobasidium pullulans
MHFSTITAALALLGLGAATPTDYSTSSYSKNQGLAQAWTSKGRQYIGTALTIRDDPVEQGIIQSRTDFNSITPENAMKWESTEPQRNNFTFAGADAVADFADRYNKEMRCHTLVWHSQLPAWVSQGNFDNKTLISIMENHIKKVAGRYKNKCTHWDVVNEALNEDGTYRSSVFYNTIGEAFIPIAFRFAEKYAGSKTKLYYNDYNLEYGSAKALGAQRILKLVQSYGVQIDGVGLQAHLSSEATASTGGGVTPDVQTLTNVLKLYTDLGVEVAYTELDVRFTTPATDAKLKAQADAYARVVQSCINVKRCVGITVWGVSDKYSWIPGVFPTEGAALLWDENFNKKPAYSSVLKTIQSFRKS

SEQ ID NO: 44 - protein, 358 aa, Streptomyces avermitilis
MPHTTAAHRRRASRPLPLVAVGALVAAAVALPQLTPDAFAATTLRGYADGRGVRIGAAVGDSPLRSDSAYTTALDREFNSVTAENAMKWDAVEPSRGGFDWAAADRLVAHASAHGQGVRGHTLAWYAQLPSWLKNGNFSASELNTILKSHIDTEVGRYKGKVYAWDVVNETFNEDGSMRGSLWQDKLGTGYIANALRWAHAADPAAKLYINDYNIEADNAKSDALYALAKQLLADGVPLHGIGFQSHFVVGQVPSTMKANLKRFSDLGLEVSVTELDIRIPLPASSDELAQQSADYKTASENCLGVARCAGITVWGVSDKYSWIPGTFSGYGAALPYNESYAAKPAYTGLSNGLDPTA

SEQ ID NO: 45 - protein, 451 aa, Streptomyces avermitilis
MRSLKRSGLSPASLLTGIAALAALLAAAPAAHAADTPLRDLAAAKGKVIGTAVTGSKLTGTYGDIAGAQFNSLTPGNAMKWGSVEPTQGTYNWTEADQIVAFAQAHNQQVRGHTLVWHSQNPSWLTNGTWTPAQLGTLLQNHITTEVTRYQGKLAAWDVVNEPFNEDGTYRSTLWYNGLGSDYIAQALTAARAADPSAKLYINDYNVEGVNAKSTALYNLVKSLKDRGVPIDGVGLQAHLVLGQVPSTLQQNIQRFADLGVDVAITELDIRMQLPATDAKLTQQAADYKAVLDACVAVTRCVGVTVWGFTDSDSWIPDVFSGYGAATPYDENYAPKPAYHAIATALGGTSTPPTGACTATYSVTSQWNAGFTGQVRIACSGASLSAWKVSWTYGAGQQITQAWNATCTQSGTAVSCANASYNGTVPNGGSVTFGFNASWSGSNPLPTVTLG

SEQ ID NO: 46 - protein, 436 aa, Streptomyces avermitilis
MILTSDLGDGTYRTPVLNADWSDPDLLRVGDDFYLTASSFGRAPGLPLPHSRDLVNWRLVGHALPRLEPAHEFRTPRHDCGVWAPSLRHHYGWLWISAPAGGVQTGWQGAFRSPGFFGPYEERIVLEQGDTDVDGPHQGGWVRTPAGEDWFAHFQARGAYGRVVHLQLMRRGSDGWPVIGNEGVPVAVHRKPDLPRQPPSAPATDDDFPGGRFGRQWQWTANPLPSSRLRSSRGDPHDGWATQLSGDGLRLTCVRTADAHDLRKLPNVLTQRLPGAPATVEVELRLDSEEPGARAGLAVLGDAFSWIGLQRGRDGSVQLVHRFDESVAMGAPPTPSGQWGKERDAAHARLAPGGRARLWIEIGRGARCRFSYDTGDGRRPSGPVFAATPWRWVGALIGLVALAPVGAGHAGAATFTRFRGTAAGSASLSAPASTSA

SEQ ID NO: 47 - protein, 735 aa, Streptomyces avermitilis
MRRTARTLLVPLLALLLGLLAAPPSPAAQSGAPHVNAAKYAGYLFAYFTGEGTADGEQIRYALSRGNDPLHWRELNAGKPVLTSDLGEKGLRDPFVIRSPKGDKFFLIATDLKMYRNSSGSWDQVQRHGSRSIMIWESTDLVHWTDQRLVRVAPGNAGNTWAPEAYWDDTLGAYVVFWASKLYADDDPDHTGSTYNKMLYATTKDFRTFSEPKVWDDPGYSVIDSTVIKHKGSYYRYTKDERDPSSSSPCSKFITGEKSTSLTDPTYDFVSDCIGSGSIDRGEGPTVFKSNTENKWYLFIDEYGGRGYVPFETTDLDSGEWTMSTDYQLPASPRHGTVMPVTRAEYDRLLAAYPVSGTSVVDATAKGQKGYAVVSEDTAKVVLPMKPDADLRRLAPALAVGAGATLSPRSGTRRDFRRPQTYTVTAADGTRRTWTVEAVPTRSPVLPGLYADPDIQYLDGRYWIYPTTDGFPGWSGTRFKAFSSKDLVHWKDHGVILDLGPDVTWADKNAWAPAIAERDGKYYFYFCAEQQIGVAVADSPAGPFKDALGKPLVAKGKLAGQMIDPAVFTDDDGTSYLYWGNGHGYVVPLNDDMVSYDATKVKDITQPDFREGSFVVERQGTYYFMWSEDDTGSENYHVSYATGPSPLGPWTKRGTILSKRPEYGIKGTGHHSVVNVPGTDDWYIVYHRFALSGPGKAGGDGTHRETTIDRMTFAADGTIEPVTPTLESVRPVRAN

SEQ ID NO: 48 - protein, 422 aa, Bacillus subtilis
MIPRIKKTICVLLVCFTMLSVMLGPGATEVLAASDVTVNVSAEKQVIRGFGGMNHPAWAGDLTAAQRETAFGNGQNQLGFSILRIHVDENRNNWYKEVETAKSAVKHGAIVFASPWNPPSDMVETFNRNGDTSAKRLKYNKYAAYAQHLNDFVTFMKNNGVNLYAISVQNEPDYAHEWTWWTPQEILRFMRENAGSINARVIAPESFQYLKNLSDPILNDPQALANMDILGTHLYGTQVSQFPYPLFKQKGAGKDLWMTEVYYPNSDTNSADRWPEALDVSQHIHNAMVEGDFQAYVWWYIRRSYGPMKEDGTISKRGYNMAHFSKFVRPGYVRIDATKNPNANVYVSAYKGDNKVVIVAINKSNTGVNQNFVLQNGSASNVSRWITSSSSNLQPGTNLTVSGNHFWAHLPAQSVTTFVVNR

SEQ ID NO: 49 - protein, 513 aa, Bacillus subtilis
MRKKCSVCLWILVLLLSCLSGKSAYAATSTTIAKHIGNSNPLIDHHLGADPVALTYNGRVYIYMSSDDYEYNSNGTIKDNSFANLNRVFVISSADMVNWTDHGAIPVAGANGANGGRGIAKWAGASWAPSIAVKKINGKDKFFLYFANSGGGIGVLTADSPIGPWTDPIGKPLVTPSTPGMSGVVWLFDPAVFVDDDGTGYLYAGGGVPGVSNPTQGQWANPKTARVIKLGPDMTSVVGSASTIDAPFMFEDSGLHKYNGTYYYSYCINFGGTHPADKPPGEIGYMTSSSPMGPFTYRGHFLKNPGAFFGGGGNNHHAVFNFKNEWYVVYHAQTVSSALFGAGKGYRSPHINKLVHNADGSIQEVAANYAGVTQISNLNPYNRVEAETFAWNGRILTEKSTAPGGPVNNQHVTSIQNGDWIAVGNADFGAGGARSFKANVASTLGGKIEVRLDSADGKLVGTLNVPSTGGAQTWREIETAVSGATGVHKVFFVFTGTGTGNLFNFDYWQFTQR

SEQ ID NO: 50 - protein, 213 aa, Bacillus subtilis
MFKFKKNFLVGLSAALMSISLFSATASAASTDYWQNWTDGGGIVNAVNGSGGNYSVNWSNTGNFVVGKGWTTGSPFRTINYNAGVWAPNGNGYLTLYGWTRSPLIEYYVVDSWGTYRPTGTYKGTVKSDGGTYDIYTTTRYNAPSIDGDRTTFTQYWSVRQSKRPTGSNATITFSNHVNAWKSHGMNLGSNWAYQVMATEGYQSSGSSNVTVW

SEQ ID NO: 51 - protein, 520 aa, Clostridium phytofermentans
MLQKMNGKVKKILGISIAFLMLIMVIPTSIAKAATNKTYDFNSMTYQSTWGVTYSISNGSGTFNFTGQYREIKFNLPETLDMSQCTSVTFNASSPNGQIAFKLYDTSGNQVAVVYNFNSNTSDCTFAPNSTAKVNSIGIMAQGTNNYSAVVNRVTFTMTGGSSGTGSSTLLNTYGNILKNSGTAVNLSQLQNSNTLSVIKTQYNSITLENEMKPDAVLGSSSTLMTVAQAKSNGYYIPSSYTESTVPTLKFSTIDAVLQICYNNGLKLRGHTLVWHSQTPDWFFRTGYSSSGSYVSQAVMDARMEMFIRSYMSHIYNGSYGSVVYAWDVVNEYLHASTSGWSQVYGSNLGTTPSYVKKAFQYAYDCLSSFGLTNSVKLFYNDYNTYEVTDQILSLVNFINSGTKLCAGVGMQSHLNTSYPSVSAYKTAMQKFLNAGYEVQVTELDVTNTSASTQATYVYDLMTAILSLKKAGGNITGITWWGLYDSVSWRASQNPLLFSNLTTPKESYNKALQAFTDAGY

SEQ ID NO: 52 - protein, 756 aa, Clostridium phytofermentans
MFFKKLVALAMAVAIVIPMNVNNIQKVEAESTNEAVVYGNLIYHDFEASTNGWGPRGDNAEVVAQSTEEAYSGLHSLKISKRTQTWHGATCDLTKELTIGETYVFGIYLKYKGSSYSNTQKFSLQFQYNDGVNDQYKTIKTLEVTKDKWTLIQGEYTVPADAANAKVYVETEYKSSPSSQDLLDFYIDDFTATPATLPQIQKDIPSLKDVFSSYFFVGGAATAGEIAPAPAKDLVAKHYNRLTPGNELKPDSVLDYSATIAYMDANGGNQVNPQVNLRAAKTLLEYARDNNIPVRGHTLVWHSQTPDWFFKVNYSQDSNAAWVSKEVMLQRLENYIKNVMQLISSTYPTVKFYAWDVVNEAVDPNTSTGMRNPGSNNVTSGNSPWMQTIGEEYIQRAFEYARKYAPTGCKLFYNDYNEYEDRKSTFIFNILKGLKDKGLVDGMGMQSHWVMDYPSISMFETAVRKYNTLGLELQLTELDIKQPDNSTSALAAQADRYKLLINKVISLKKEGMNITGVIFWGVTDKTSWLGGYPLLFDGNYQAKSAYYSIIDGITPTVTPSITPTVTPKPTITPTVTPTVTPKPTITPTVTPTVTPKPTITPTITPTVTPKPTIAPTPTPTTVPVEGAKPVVVVTTKNNGNTISQQYTINALGGTIDLSKVSIEFTADGIINQEHNVWVDNAALQLTVEPYYTPLNGYVSGQLTNQKLVVSISKSTMLSEGTGKLVLDLRFAKKDWTDFGTISNEVLKVYYNGVKVQ

SEQ ID NO: 53 - protein, 212 aa, Clostridium phytofermentans
MFKLNKKVFALVSVIALGFSSLFTSTAHAATDYWQNWTDGGGTVNATNGSGGNYSVNWTNCGNFVVGKGWGTGNASRVVNYNAGVFSPSGNGYLTFYGWTRNSLIEYYVVDSWGTYRPTGTLKGTVSSDGGTYDIYTSTRTNAPSIDGTQTFQQYWSVRQSKRATGSNVAITFSNHVNAWKSKGMNLGSSWAYQALCVEGYQSSGSANVTVW

SEQ ID NO: 54 - protein, 806 aa, Clostridium phytofermentans
MGKKVIALLTCVMLSLTLIPGIGIKSTAQAAETNIYKVDWSKFNEGDKISGPMEGLGRSGGADITVTGSSTKSFYISNRKDNWDALDIQNDLLKLDRDATYEITVTGHVDSNVDTKNASVKLGGVTRKTGEDDGYPEFKKEKLQSGKSFVLTYELKLSDQIPDASRNLWVLRVQTDEPSGSRAGDLVPFYVDDIVIIQTKASTAPVAVTGDLMSLYELNADKTLKVGESLSSPALKVSGNAKIVVVEGTDGTVSLQLKDRVNNYDGVDILRDALKINDKFMSGTYTIEVKGHVEDGSDLSKSQFVMGMTESPWGELTSRVTPSSDGSFVITYTKAYTGSELTGLGYSYRVQTPPSVLTSFYIDNITVTVQGAEEEDESTVVIPEWDLTLDSIKDAYADYFMIGNIMEPGQIQDTETTEMFKHHYNVVTAENAMKPGNISKVKGEYNFDNADKLVTWAKENGLKVHGHTLVWHSQSAPWLTTNADGTPLTRAEARANMEDYIKNVAGHYAGKVISWDVLNEAFLPGVSEIPAGWRDVLRKFEDNGNGSPWYQAYENGADKSKGEDGSDYIYDAFVFTRLAAPDAVLYYNDFNETEAGKCEAIALMVEELNTKWKTDKRNTEPDRLLIEGIGMQAHYWTGDLKVSTVEASIKRFIKTGAKISVSELDVPHGDYMTYKQRTDSPTKEEEKLQADLYKQLFEVYKKYADNIERVTFWGKTDPQSWRFQGYPLLFDKNFAPKDAFFAVIDVAKEKVAEEKAVETIPGKDIPKTGEDSSKQMILTAVAILIILVFVPVTILTKRREKNIKNI

SEQ ID NO: 55 - protein, 381 aa, Clostridium phytofermentans
MNGAIKSGYYRNVFTELGYKEEDVTKKVEDSFQTLFYGLPEERIYYPVGEDLGYIVDTGNHDVRTEGMSYGMMMCLQLDKKEEFDRLWKWAKTYMFMDSGVNKGYFAWSCKTDGTKNSYGPAPDGEEYFALALFFASNRWGDGNGIFEYSKQARELLHECIHKGEEDGIGEPMWEPSNYLIKFIPNCNFTDPSYHLPHFYGLFALWAYEEDREFFKKAAEASRSYLKLACHEKTGLCAEYTEYDGTAHSGDQEIFGRHDWYYSDAYRTIANIGLDYLWFAADEWQVTCANHLQQFFCETVKEHASGIYQVDGTIIKGEALHPVAIIATNAQASLAANGPFAKECVDKFYHTELRTGDRRYYDNCLYMFALLALSGKYRMWM

SEQ ID NO: 56 - protein, 395 aa, Thermobifida fusca
MGLPVSVHRSDTKMRVGRYIAITVGASALLVSGVAPAAAGTLPTSGTAAGAASQAGHDQKQVPLRKVAPKGFAIGVAVAGGGHHLDQEYPDPFKYDEEYRGVLAKHFNSVTPENHLKWDFVHPERKKYNFGPADQIVKFAQSNGQKVRGHTLVWHSQNPDWLTKGKFSKKELRKILKEHIITVVGRYRGKIHQWDVANEIFDDNGKLRTNENIWLKNFGPEIIADAFRWAHQADPKAKLFLNDYGAEGINKRSDAYLKFMKELRKKGVPVHGFGVQGHLSLAYPFPGDMAKNLKRFSDAGFEVAVTEVDVRIPLNGGDATEAQLKTQADYYRRALEACLSVKSCNSFTLWGTTNKYSWVPVFFPDEGEATIFWDDFSPKPAYTALQEALAKARRR

SEQ ID NO: 57 - protein, 338 aa, Thermobifida fusca
MNHAPASLKSRRRFRPRLLIGKAFAAALVAVVTMIPSTAAHAAVTSNETGYHDGYFYSFWTDAPGTVSMELGPGGNYSTSWRNTGNFVAGKGWATGGRRTVTYSASFNPSGNAYLTLYGWTRNPLVEYYIVESWGTYRPTGTYMGTVTTDGGTYDIYKTTRYNAPSIEGTRTFDQYWSVRQSKRTSGTITAGNHFDAWARHGMHLGTHDYMIMATEGYQSSGSSNVTLGTSGGDNPGGGNPPGGGNPPGGGGCTATLSAGQQWNDRYNLNVNVSGSNNWTVTVNVPWPARIIATWNIHASYPDSQTLVARPNGNGNNWGMTIMHNGNWTWPTVSCSAN

SEQ ID NO: 58 - protein, 760 aa, Clostridium thermocellum
MIVGKVLDMDEKTAIIMTDDFAFLNVVRTSEMAVGKKVKVLDSDIIKPKNSLRRYLPVAAVAACFVIVLSFVLMFINGNTARKNIYAYVGIDINPSIELWINYNNKIAEAKALNGDAETVLEGLELKEKTVAEAVNEIVQKSMELGFISREKENIILISTACDLKAGEGSENKDVQNKIGQLFDDVNKAVSDLKNSGITTRILNLTLEERESSKEENISMGRYAVYLKAKEQNVNLTIDEIKDADLLELIAKVGIDNENVPEDIVTEDKDNLDAINTGPAESAVPEVTETLPATSTPGRTEGNTATGSVDSTPALSKNETPGKTETPGRTFNTPAKSSLGQSSTPKPVSPVQTATATKGIGTLTPRNSPTPVIPSTGIQWIDQANERINEIRKRNVQIKVVDSSNKPIENAYVEAVLTNHAFGFGTAITRRAMYDSNYTKFIKDHFNWAVFENESKWYTNEPSMGIITYDDADYLYEFCRSNGIKVRGHCIFWEAEEWQPAWVRSLDPFTLRFAVDNRLNSAVGHFKGKFEHWDVNNEMIHGNFFKSRLGESIWPYMFNRAREIDPNAKYFVNNNITTLKEADDCVALVNWLRSQGVRVDGVGVHGHFGDSVDRNLLKGILDKLSVLNLPIWITEYDSVTPDEYRRADNLENLYRTAFSHPSVEGIVMWGFWERVHWRGRDASIVNDNWTLNEAGRRFESLMNEWTTRAYGSTDGSGSFGFRGFYGTYRITVTVPGKGKYNYTLNLNRGSGTLQTTYRIP

SEQ ID NO: 59 - protein, 654 aa, Clostridium stercorarium
MKRKVKKMAAMATSIIMAIMIILHSIPVLAGRIIYDNETGTHGGYDYELWKDYGNTIMELNDGGTFSCQWSNIGNALFRKGRKFNSDKTYQELGDIVVEYGCDYNPNGNSYLCVYGWTRNPLVEYYIVESWGSWRPPGATPKGTITVDGGTYEIYETTRVNQPSIDGTATFQQYWSVRTSKRTSGTISVTEHFKQWERMGMRMGKMYEVALTVEGYQSSGYANVYKNEIRIGANPTPAPSQSPIRRDAFSIIEAEEYNSTNSSTLQVIGTPNNGRGIGYIENGNTVTYSNIDFGSGATGFSATVATEVNTSIQIRSDSPTGTLLGTLYVSSTGSWNTYQTVSTNISKITGVHDIVLVFSGPVNVDNFIFSRSSPVPAPGDNTRDAYSIIQAEDYDSSYGPNLQIFSLPGGGSAIGYIENGYSTTYNNVNFANGLSSITARVATQISTSIQVRAGGATGTLLGTIYVPSTNSWDSYQNVTANLSNITGVHDITLVFSGPVNVDYFVFTPANVNSGPTSPVGGTRSAFSNIQAEDYDSSYGPNLQIFSLPGGGSAIGYIENGYSTTYKNIDFGDGATSVTARVATQNATTIQVRLGSPSGTLLGTIYVGSTGSFDTYRDVSATISNTAGVKDIVLVFSGPVNVDWFVFSKFRNLRV

SEQ ID NO: 60 - protein, 387 aa, Clostridium stercorarium
MNKFLNKKWSLILTMGGIFLMATLSLIFATGKKAFNDQTSAEDIPSLAEAFRDYFPIGAAIEPGYTTGQIAELYKKHVNMLVAENAMKPASLQPTEGNFQWADADRIVQFAKENGMELRFHTLVWHNQTPTGFSLDKEGKPMVEETDPQKREENRKLLLQRLENYIRAVVLRYKDDIKSWDVVNEVIEPNDPGGMRNSPWYQITGTEYIEVAFRAAREAGGSDIKLYINDYNTDDPVKRDILYELVKNLLEKGVPIDGVGHQTHIDIYNPPVERIIESIKKFAGLGLDNIITELDMSIYSWNDRSDYGDSIPDYILTLQAKRYQELFDALKENKDIVSAVVFWGISDKYSWLNGFPVKRTNAPLLFDRNFMPKPAFWAIVDPSRLRE

SEQ ID NO: 61 - protein, 1032 aa, Clostridium stercorarium
MNGRNGGKRPIASLLVLTLAFLFIPVTKAETTVYHETFAEGKGAAVQSGGATITHVTGKFFDGNGDGAALYISNRVNNWDAADFRFSDIGLQDGRIYKITVKGYVDPDVHVPEGSQIWLQTVNSYGWWGSTDIKAGEAFTLTGVYKVDTTNDYALRIQSNDTGAFVPFYIGEILITEETVPQDDSRNGNKTHAEKFTPITFEDQTTGGFTGRAGTEILTVTDEANHTDGGRYSLKVGGRNDTWHGPALGVEKYVDQGYEYKVAVYVRLISPESAQLQLSTQIGEGTSASYVNLAKKNVAISDGWVLLEGTYRYDNLGGGYLTIYVESPDSPEASFYIDDINFEPTGMKSEEIEKGLKSLKDVYKDNFLTGTAISLRDLEGVRFELLKKHFNAVTAENAMKPSELQREKGNFTFDGADRLVNAAISAGMKVHGHTLVWHQQTPAWMNIKLDSGGNIVYLSREEALENMRNHIRTVIEHFGDKVISWDVVNEAMSDNPSNPSDWRGSLRKSPWYYAIGEDYVEQAFLAAREVLDEHPEWDIKLYYNDYNLDNQNKALAVYNMVRELNEKYQKTHPGKLLIDGIGMQGHYSVNTNPKNVELSLKRFTELGVEVSISELDIRAGSNYQLTEKEANAQAYLYAQLFKIFREYSDSIARVTFWGMDDGTSWRAEESPLLFDRTLKAKPAYYAVADPDEFIEKYKPETIEANRAYAVYGTPEIDGKTDEVWNKAPELKINRYQTAWHGADGTARVLYDENNLYVLIKVNDTQLDKGSPNPWEQDSVEIFIDENNAKTSFYEEDDGQYRVNFENETSFNPESIAGGFESAAEVSGTNYTLEVKIPFRTVKPVSNMQIGFDVQINDGKNGVRQSIATWNDPTGNAWQDTSVFGILTLKSKNPVTRGEAIVKIMKAYDMEPLENWNDNFSDASGSYAGYYPRAKETGFVSGIGDNKIGAEIPLTREMFFTMIYNIERITGKMQGIDISDAELTLFSDYNDLSEWAEEAVKALVKSGRIKINGDLLPKRLMDAEEVEAFLRLR

SEQ ID NO: 62 - protein, 688 aa, Anaerocellum thermophilum
MSVCLYKRLKRFSVLILVILFLIVTLIGIETTKTSRVIGETKKSFVEYNFENRFIAPFKASGKSMSLRIDNTTAAEGTFSLLASGRKQIDDGILLDVTNLIDYANEYKITLYVYHKSSKMQRFVVSSEIETKSGKKTKLLCEKIIIPKSWKKLDANLNLTEQKGIKKVWLKVYVPTSTTNFYVDLFTLKVADKSHLIKFENFEDKSIAGFISQDKKCKLSISKEKAYQGTYSIKVQQTVKRQNTTVILPVKGTFEKGKSYSISFYMHQSILKSLNFAVGIRFLESGKNMREIVLGRVTIPKNKWTEVFASYTPSLDSKIKDFVIFIRPLSDISYYYIDNFTISDDGWYSAVPDLDLPSLREKYKNYFKIGVAVPYRALTNPVDVAFIKRHFNSITAENEMKPEALEPIEDNFNFSIADEYLNFCRKNNIAIRGHNLLHQQTPNWFFENPQTGKKLTNSEKDKKILLERLKKYIQTVVSRYKGRIYAWDVVNEAIDENEPDGFRRSDWFNVLGPEYIEKAFIYAHQADPNAQLFYNDYSTENPVKREYIYKLIKSLREKGIPIHGVGLQCHISVSWPSVEEVEKTIKLFSSIPGIKIHVTEIDISVAKEYGEDIDEETKRYLLIQQARKLKDLFDVFKKYKNVVTSVSFWGLKDDYSWLQGDFPLLFDKDYQPKFAFWSLIDPSVVPEE

SEQ ID NO: 63 - DNA, 1101 bp, Pyrenophora tritici-repentis
atgttgttgcaagcttttttgtttttgttggctggttttgctgctaaaatttctgctcatcatcaccaccaccacccaccttctccaccttctgatgatgatgacaaatccgttgctgtttatgatccaccagttattaacactttccatcaatgtgatccagctgctcatgtttggaaacatgatccaaatactgtttacgtttacggttctcatgatgttaattctactaagaatccaccagttcaatatgatatgaaggattactacgttttgattcaagttgatattactaaaccagctactgttggtccaaagattttggatttgccagatattccatgggcttctcaacaattgtgggctccagatgttgctgaaaaaaatggtgaatacttcttgtattttccagctaaagataaggatggtgtttttagaattggtgttgctaaatctgataaaccagacggtaaattcaaagctgaaccatcttatattccaggtgcttattctattgatccagctattttggctgatgatgatggttgttactacatgtattttggtggtttgtggggtggtcaattgcaagcttggccaaacaatactttgaatacttctgctttcggtaatatttctccatcttctggtccagctttgggtccaagatttgctaaattgtctgctaatatgacacatttggctactgaaccaaaagaattggttatctacgataaagatggtcaagttatgcaagctaattctactagaagatactttgaagctccatctattaacaaagttggtaacttgtattacttgcaatattctactggtacttctcatactattgaaattgctgttggtaaaaaaccagaaggtccattttattggaaatctaccttgttgcaaccagttaaaggttggactactcatgaatctattgttaagtttaagggtgattggttgttgtattatgctgatgcttctttgactggtattgatgatttgagaaacactaaggttagaaagttgaattttgctaatggtacttttgctttggctcaaccacaaccatatactccatttccatcttcataa

SEQ ID NO: 64 - DNA, 2604 bp, Aspergillus niger
atgagatttccttcaatttttactgcagttttattcgcagcatcctccgcattagctgctccagtcaacactacaacagaagatgaaacggcacaaattccggctgaagctgtcatcggttacttagatttagaaggggatttcgatgttgctgttttgccattttccaacagcacaaataacgggttattgtttataaatactactattgccagcattgctgctaaagaagaaggggtatctttggataaaagagaggctgaagcttatcgatacaccagctatgtcgattacaacgtcgaggccaaccctgacttgtaccctttgtgcatagaaaccatcccactgagcttccccgactgccagaatggccccctgcgcagccacctcatctgcgacgaatcagccaccccctatgaccgagcagcatcgctcatctcgctcttcacgctggacgagctgatcgccaacaccggcaacaccggcctcggtgtctcccgactgggcctccctgcataccaagtatggagtgaagcacttcacggcctcgaccgtgccaacttcagcgactcaggctcctacaattgggctacttcattcccccaacctatcttgaccaccgcggccctcaaccgcaccctcattcaccaaatcgcctccatcatctccacccaaggccgtgccttcaacaacgccggccgctacggcctcgatgtctacgcccccaacatcaacaccttccgccaccccgtctggggtcgcggacaagaaactccaggagaggacgtctctctcgccgccgtctacgcctacgaatacatcaccggcatccagggtcccgacccagactcaaacctcaaacttgccgccacggccaagcactacgccggctatgacatcgagaactggcacaaccactcccgcctgggcaatgatatgaacatcacccagcaagacctgtcagaatactacactccccagttccacgtcgccgcccgcgacgccaaagtccacagtgtcatgtgtgcctataacgccgtcgacggcgtccctgcctgcgccgactcttacttcctccagaccctcctccgcgacaccttcggattcgttgaccacggctacgtctccagcgactgcgacgccgcctacaacatctacaatccccacggctacgcctcctcccaggctgccgctgccgctgaggccatcctcgctggcactgacatcgactgcggtaccacctaccaatggcacctgaacgagtccatcactgcgggagatctctctcgcgatgatatcgagaagggtgtgatccgcctctacacgacccttgtgcaggccggatacttcgactccaataccaccaaggcgaacaacccctaccgcgacctcacctggtccgatgtcctcgagacggacgcatggaacatctcctaccaagccgcgacgcagggcattgtccttctcaagaactccaacaacgtccttcccctcaccgagaaagcttacccaccatccaacaccaccgtcgcccttatcggtccctgggccaacgccaccacccaactcctgggcaactactacggcaacgctccctacatgatcagcccccgcgccgcgttcgaagaagccggatacaaagtcaacttcgccgaaggcaccggtatctcctccacaagcacctcgggcttcgcagccgccttatccgccgcccggtccgccgacgtgatcatctacgccggtggtatcgacaatactcttgaagcggaggcactggatcgcgagagcatcgcatggccgggtaaccaactggacttgatccaaaagctcgcctcgtcggccggaagcaagccgctcatcgttctccaaatgggcggcggacaggtcgattcctcgtccctcaagaacaacacgaacgtcactgcactcctctggggcggataccccggccaatccggcggtttcgctctgagagacatcatcacgggaaagaagaaccccgcgggtagactagtcacgacacaatacccagccagctacgcggaggagttccccgcgacggatatgaacctccgtcctgagggtgataaccccggccaaacatacaaatggtacaccggcgaagcagtgtacgagttcggccacggattattctacacgaccttcgcggaatcatccagcaacaccactacgaaggaagttaagctcaacatccaggacattctttcccagacacacgaagagctagcctcaattacgcagctccctgtgctgaacttcactgccaatatcaagaacactggaaagctggaatcggattacaccgctatggtattcgccaatacctctgatgccggtccggcgccgtacccggtgaagtggctggtcgggtgggatcggcttggggatgtgaaggtcggggagacgagggagttgagggttcccgttgaggtggggagctttgcgagggtgaatgaggatggcgattgggtgttgtttccgggaacgtttgagttggcgttgaacctggagaggaaggttagggtgaaggttgttcttgagggtgaggaggaagtcgtgctgaagtggcctgggaaggagtag

SEQ ID NO: 65 - DNA, 2409 bp, Aspergillus nidulans
atgttgttgcaagcttttttgtttttgttggctggttttgctgctaaaatttctgctaacacttcttacactgattacaatgttgaagctaatccagatttgtttccattgtgtttgcaacatttgaatgcttcatttccagattgtgctactggtccattgtctttaactccagtttgtgatagatcattgtctccaaaagatagagctactgctttggtttctttgtttacctttgatgaattggttaacaatactggtaatacaggtttgggtgtttctagattgggtttgccaaattatcaagtttggggtgaagctttgcatggtgttggtagagctaattttgttgaatctggtaatttttcttgggctacttcttttccaatgccaattactatgatggctgctttgaacaaaactttgattcatcaaatcggtactattgtttctactcaattgagagctttttctaatgctggtttgggtggtgttgatgtttattctccaaacattaacacttttagacatccagtttggggtagaggtcaagaaactccaggtgaagatgcttttttgacttctgtttacggttatgaatacattactgctttgcaaggtgctgttgatccagaaacttctaagattattgctactgctaaacattatgctggttacgatattgaatcttggaacaaccattctagattaggtaacgatatgcaaattacccaacaagaattgtctgaatattacactccaccatttattgttgcttctagagatgctaaagttagatcagttatgtgttcttacaatgctgttaatggtgttccatcttgtgctaacaagtttttcttgcaaactttgttgagagataccttcgaattttctgaagatggttacgtttctggtgattgtggtgctgtttacaatgtttggaatccacatggttatgcttctaatgaagctgctgcttctgctgattctattttggctggtactgatattgattgtggtacttcttatcaatggcattctgaagatgcatttgaagattctttggtttctagatccgatattgaaagaggtgttattagattgtactccaatttggttcaagctggttattttgatggtgaagatgcaccatatagagatattacttgggatgatgttttgtctactgatgcttggaatattgcttatgaagctgcagttgaaggtattgttttgttgaagaacgatgaaactttgccattgtctaaggatattaagtctgttgctgttattggtccatgggctaatgttactgaagaattgcaaggtaattactttggtccagctccatatttgatttctccattgactggttttagagattctggtttggatgttcattatgctttgggtactaatttgacttctcattctacatctggttttgaagaagctttgactgctgctaaacaagctgatgctattatctttgccggtggtattgataatactattgaagctgaagctatggatagagaaaacattacttggccaggtaatcaattggatttgatttctaagttgtctgaattgggtaaaccattggttgttttgcaaatgggtggtggtcaagttgattcttcatctttgaaggataacgataatgttaatgctttgatttggggtggttatccaggtcaatctggtggtcatgctttggctgatattatcactggtaaaagagcaccagctggtagattggttactactcaatatccagctgaatatgctgaagtttttccagctattgatatgaatttgaggccaaatgaaacttctggtaatcctggtcaaacttatatgtggtatactggtactccagtttatgaatttggtcatggtttgttttacactactttcgaagaatctactgaaactactgatgctggttcttttaacattcaaactgttttgactactccacattctggttatgaacatgctcaacaaaagactttgttgaatttcactgctactgttaagaatactggtgaaagagaatctgattatacagctttggtttacgttaatactactgctggtcctgcaccatacccaaaaaaatgggttgttggttttgatagattgggtggtttggaaccaggtgattctcaaactttgactgttccagttactgttgaatctgttgctagaactgatgaacaaggtaatagagttttgtatccaggttcttatgatgttgcattgaacaatgaaagatccgttgttgttaagtttgaattgaaaggtgaagaagctgttattttgtcttggccagaagatactacttctgatttcgtttcttctattgatggtggtttggatagaaaacaagatgttatcgcctaa

SEQ ID NO: 66 - DNA, 987 bp, Cochliobolus carbonum
atgtccgttcaagcttatgatccaccattgatttctactttccatcaatgtgatccagctgctcatgtttggaaacatgatccaaacactgtttacatttacggttctcatgattggaactctactagacaaccaccagttcaatatgatatgaaggattactacgttttaactcaaactgattacactaaaccagctactgttggtccaaaattgttggatttggttgatattccatgggctactcaacaattgtgggctccagatgctactgaaaaagatggtcaatactacttgttttttccagctaaagataaggatgatgttttcagaattggtgttgctaaatctgataaaccagacggtaaattcaaaccagaaccaaatccaattgctggtacttattctattgatccaaccattttggaagataatggtaactattatatggtttggggtggtttgtggggtggtcaattgcaagcttggactaacaatgttttgaacacttctttgtttggtaacaatgctccaacttctggtccagctattggtccaagatttgctaaattgtctgctaatttgacttctttggctactactccaaaagaattggttatctacgatcaagatggtaaagttatgcaagctggttctactagaagattttttgaaggtccatctttgaacaaagttggtaacttgtacgttttgcaatattctactggtacttctcatactgttgaaattgctactgctactaaaccagatggtccatattattggaaatctaccttgttgcaaccagttaaaggttggactactcatgaatctattgtcaagtttaagaacgattggttgttgtattatgctgatgcttctttgtctggtagagatgatttgagaaacactaaggtcagaaagattttgtttgaaaacggtacttttaagttggctcaaccacaaccagttattccatcttcttaa

SEQ ID NO: 67 - DNA, 1008 bp, Penicillium herquei
atggacccaaagccattgattactcatttgtatactgctgatccatctgctcatgtttttaacggtaagctatacatttatccatctcatgatagagaaactgatattgcttttaacgataacggtgatcaatatgatatgaccgattaccatgttttttctatggattctattgatggtccagttgaagattctggtgttgttttgtctgctaaagatgttccatgggtttctaaacaaatgtgggctccagatgctgctactaaaaatggcaaatactacttggtttttccagctagagatcaagaaggtattttcagaattggtgttgctatttctgattctccaactggtccatttgctccagaaaaaaactatattccaggttcttattctattgatccagctgtttttgttgatgaagatgaaaaaccatacttgtactttggtggtatttggggtggtcaattgcaatgttgggaaaaatctggttctgaagttaaagaaggtgatgaaatgaacggtttggtttttaatgcttctaaatctggtccacaagaaccatctggtgatggtgttccagctttgtgtccaagagttggtcaattgtctgatgacatgttgacttttgtttctccaccacaagaattgcaaattttggctccagaaactggtgaaccaattgctgctgatgatcatgaaagaagattttttgaagctgcttggatgcacagatataatggtcaatactacttctcttattctactggtgattctcattatttggtttatgctactggttcttctccattgggtccatttacttatcaaggtagaattttggaaccagttttgggttggactactcatcattccattgttgaatttcaaggtaaatggtacttgtttttccatgattgtgaattgtctggtggtgttaatcatttgagatccgttaaggttagagaaattgtttatgatgctgaaggtaaaattcatttggcttaa

SEQ ID NO: 68 - DNA, 996 bp, Pyrenophora tritici-repentis
atgtccgttgctgtttatgatccaccagttattaacactttccatcaatgtgatccagctgctcatgtttggaaacatgatccaaatactgtttacgtttacggttctcatgatgttaattctactaagaatccaccagttcaatatgatatgaaggattactacgttttgattcaagttgatattactaaaccagctactgttggtccaaagattttggatttgccagatattccatgggcttctcaacaattgtgggctccagatgttgctgaaaaaaatggtgaatacttcttgtattttccagctaaagataaggatggtgtttttagaattggtgttgctaaatctgataaaccagacggtaaattcaaagctgaaccatcttatattccaggtgcttattctattgatccagctattttggctgatgatgatggttgttactacatgtattttggtggtttgtggggtggtcaattgcaagcttggccaaacaatactttgaatacttctgctttcggtaatatttctccatcttctggtccagctttgggtccaagatttgctaaattgtctgctaatatgacacatttggctactgaaccaaaagaattggttatctacgataaagatggtcaagttatgcaagctaattctactagaagatactttgaagctccatctattaacaaagttggtaacttgtattacttgcaatattctactggtacttctcatactattgaaattgctgttggtaaaaaaccagaaggtccattttattggaaatctaccttgttgcaaccagttaaaggttggactactcatgaatctattgttaagtttaagggtgattggttgttgtattatgctgatgcttctttgactggtattgatgatttgagaaacactaaggttagaaagttgaattttgctaatggtacttttgctttggctcaaccacaaccatatactccatttccatcttcataa

SEQ ID NO: 69 - DNA, 1392 bp, Streptomyces avermitilis
atgatcctcttcgccctgtgtctcgcgttcgccggcgccctcacgaccgcgggcccggcccgggcggcggcccagaccctcaccaacggcacccagttcaccgacacttcgggcaacggcgtgcacgcgcacggcggcggggtcatcaaggtcggcggctactactactggttcggcgaggaccgcaacgccgacaacaccttcaagtacgtcgacgcctaccgctccaccgacctgaagaactgggagttccgcagccacgtcctgacccaggccggcgcgagtgagctggcgagcgccaacatcgagcgtccgaaggtcatgtacaacgcgtccaccggcaagttcgtgatgtggatgcacaaggagaacggcaccgactacagcgaggcacgcgccgcggtcgcggtgtcggacacggtcgacggcacctacacctggcagggcagcttccagccgctcggccagtacatgtcccgcgacatcacggtcttcgtcgacaccgacggcaccggttacatggtgtccgccgcccgtgagaactacgacctccagatctaccggctcaccgccgactacaccggcatcgacagcctcgtcgccgacccctggcacggcggacaccgcgaggcacccgccctcttcaagcggggcggcgtctacttcatgctgacgtcgggcgccacgggctggaaccccaaccagcagcagtacgcgaccgccacctccctggccggcccctggaccgcgatgacgaacgtcggcgactcgacggcgtacggctcgcagaccgcgtacgtccttcccgtgcagggcacttcgggcacctcgtacctctacctgggcgaccgctggggcaactccttcgggggcagcgtcaacgactcccgttacgtctggctgccgttgaccttccccacctcgaccagcctcagcatgagctggtacccggaggtaaccgtcgacacggtcgccggcacgatcagcgggacgagcgccacgtacgagacgctgaccgcccggcactccgccaagtgcgccgacgtccccagtcagtcactgctcacgggcgtcgcgctcacccagtacacctgcaacggcggcaacaaccagaagttctggttcaagtccgtcgccggcggctactacgagctgatgggccggggcagctccctgtgcctcaccgagaacgtcaccgccgtcacccaggagaactgcaccgccgcgacctcccagcagtggtcgctcaccacctcgggcggctacgtcagcctcaagtcccgcgcgagcggcgaatgcctggacgtgtccggcgcgtccaccgccaactccgccgcgctgatcacgtacacctgcaacggaggcaccaaccagcagtggacgcgtggcaca

SEQ ID NO: 70 - DNA, 2226 bp, Streptomyces avermitilis
atgacccacccctggcaggaccccgctctgcccgcagccgtccgcgccgccgacctgctcgcccggatgaccccccaggagaagaccgcccagctctacggcgtctggcccggctccgacgaggcaccgggcggggacgtggcaccgctccagcacgcgctgtccgagggcgtggacctcgccgggctgctcccgcacggcctcggccagctcacccgccccttcggcacggcgcccgtcgacccggccgagggcgccgcccggctcgggttcctccaggaacgcatccgcgccgcgaaccgcttccggctgcccgccctcgcccacgaggagtgcctcaccggcttcaccgcctggcaggcgaccatctttccgacaccgctcgcctggggcgccagcttcgatccggacctggtgaaggagatggcggccgcgatcggcgcctcgatgcgggccgtgggcgtgcaccaggggctggcccccgtcctcgacgtcgtacgggatccgcgctgggggcgcacggaggagtcgatcggcgaggacccctacctcgtggccaccgtcggcaccgcctacgtgcagggccttcagtcgtccggcgtcgtagccacgctcaagcacctcgcgggctactcggcctcacgcggcgcccgcaaccacgcgcccgcgtcgctcggcccgcgcgaactggccgacgtcatcctgccgcccttcgagatggcggtacgggagggcggcgcccggtcggtgatggcggcgtacaacgacatcgacggactgcccgcgcacgcgcaccaccggctgctcacccacctgctgcgggacgaatggcagttcaccggcaccgtcgtctccgactacttcggggtctccttcctggagtcggcccacgggctcgccgactccccggccggggcggcggcgctcgcgctcgcggccggggtggacgtggagctgcccgcggtgcggtgcttcggggccgggccgttcgacgaggaactggtggaccgggccgcgctgcgggtgctgacgcagaagtgcgagctggggctgctcgacccggactgggcgccgcccgccaccgaggccccggtcgacctggacccgccccatatgcgggcgctggcacgtcagttggcacaggagtcggtcgtcctgctcgccaacgaccggggcctgctgccgctcgctccgggggcccgccggatcgccgtcctcgggccgcacgccgacgacccggcggccatgctcggctgctacaccttcccccgccatgtcctcctggaccgccccggggtcccgatgggggtcgccgtgccgacgctgctggaggcgctgcgcacggagctgccggacgccgagttcgtgaccgacccggcggcggccgaggtgtgtgtggtcgcggtcggcgaccggtcggggctgttcggacgcggcacctcgggggagggctgcgacgcggcggacctcgaacttcccgacggacagggcgaggtggtggaccgggccctcgcctccgggacgccggtcgtcctggtcctgctgtccgggcgcccgtacgcgctcgggcgctgggcggaccggtgcgccgcggtggtgcaggcgttcttcccgggcgaggaaggaggcccggccgtggccggggtgctgtccgggcgggtcaacccgtcgggccggctgccggtgagcgtgccgcgcggcccggcgggacagccgtggacgtacctcgccccgccgctcggccggcacggcgaggcgagcaacctcgacccgacccccctgtaccccttcggacacgggctgtcgtacacgacgtacgactggcaggccccgtcggtcgacgacgcgtcgttccccacggacggcgagacgacgctgcgcctgacggtccgcaacaccggggaacggcccggcacggaggtcgtccagctctacctccacgacccggtcggcaaggtcgcgcggccggtggtccgcttggtggggtacgcccgggtgcccctcgaacccggcgcgtcgggggaggtccacttcacggttccggcggacctggccgcgtacacgggccccgacggcgagcggatcgtcgaacccggggcgctggagctgcggttgggggtgtccagcgcggacggggacgtgcggtacacggtgccggtgacgctgaccgggcccgagcgggtggtgggacgggagcggcggctgcggtgcgaggtgcgggtgaag

SEQ ID NO: 71 - DNA, 1599 bp, Bacillus subtilis
atgaagattaccaatcccgtacttaaaggattcaatcccgatccaagtatttgtagagcaggagaggattattatatcgctgtatctacatttgagtggtttccgggagtccagatacaccactcaaaagatttagtaaattggcacttagttgcacatccattacagagagtttcacaattagacatgaaaggaaacccaaattcaggtggagtttgggcaccatgtttaagctatagtgatgggaagttttggctgatctatacggatgttaaggtagtagatggcgcatggaaagattgtcacaattatttagttacttgtgaaacgattaatggtgattggagtgagccgattaaattaaatagctcggggtttgatgcttctttgttccatgatacggatggaaaaaagtatttattaaatatgttatgggatcaccgtattgatcggcactcatttggaggaattgttatacaggaatattctgataaagagcaaaaattaatcggtaaaccaaaagttatatttgaaggaactgatagaaaactgacagaagctccgcatctttatcatatcgggaactattattatttattaactgcagaaggaggaacacggtacgaacatgctgctacaattgctcgttctgcaaatattgaggggccatatgaagttcatcccgataatccaattttaacgtcatggcatgacccaggaaatccattgcaaaaatgtggtcatgcatccattgttcaaacacatacagatgagtggtatttagctcatttaacgggacgtcctattcatcctgacgatgattcaatttttcagcagagaggatactgtcctttgggcagagaaacagctattcaaaaactttactggaaagatgaatggccctatgtagtaggtggaaaagaaggaagcttggaggtagatgcaccttctatacccgaaacaatatttgaagcaacgtacccggaagttgatgaatttgaggattcaacattaaatataaattttcaaactttaaggattccattcacgaatgaattaggttcattgactcaagcgccaaatcatttacgattattcggtcatgaatcattgacctcgacatttactcaggcatttgtagccagacgctggcaaagtctccattttgaagccgaaactgctgttgagttttatccggaaaattttcaacaagccgctgggttggtgaattactacaatacagagaactggacggctcttcaagtcacgcatgatgaagaacttgggcgcattcttgaattaacaatatgtgacaacttttctttttcacagccattaaataataaaattgttattcctcgtgaagtaaagtatgtatatttaagagtaaatattgaaaaggacaaatattattatttctattcttttaacaaagaagattggcacaaaattgacattgcactggaatcgaaaaaattatcagatgattatatccgtgggggaggattcttcacaggggcctttgtagggatgcaatgccaagataccagtggtaatcatattccggccgactttagatattttcgttataaagaaaaa

SEQ ID NO: 72 - DNA, 1536 bp, Clostridium phytofermentans
atgagacaagaatattgtaatccagtacaacgaggatttttcccagatccgtctgttattcgcgttggagatgattattacatggtgaattcctcctttcaatacttcccggcaattcctatttcacattccaaggatatggttcactggcatattataggacatgcgataacgaatcctgaatatcttccattagaggatatcaaagattcacacggtatttgggcaccagatatttcgtaccatgatggaaccttttacatttatgcgacacttcgtttaaacggtagcggtaccagaggaaataatgttcttcgaagacagcttttggttacttcaaagacaccggaaggtccttactctgcacctacttggctcgaagtagatgcgattgatccatcccattttgtcgatgacgatggaaagcactatatggtaattgcgaaagcagctaccgttattccattaagtgatgatggaaaacgtgtgattggtgaaccatttgcagcatggactggaacaggagagtgttgtccagagggaccacacattttaaaaaaggatgggtactactatgctatcgttgcagaaggtggaactgggtatgggcatggaataaatgtggcacgttctaaaaacttatatggtccttatgaggagtgcccttataatccagtactgcgtcagtttaaggaggattctcctattcagcgtaccggtcatgggaaattggttcagacacaaaatggtgactggtggatgtattatttacttggtagaccaaaccaagggagatatacgaccgttggtagagaatctggccttgatccagttacctggacagaggatggctggtttatcgtaaatgaagggaaaggtccaagtgaaagacagatagctccagaccttaaaccacatgtctttgagagaaatttaaaggacgattttgaggaagagaagcttaatttagattgggaatttgttcgaaatcctgactatggtagctgttcgtcaacagagagacctggatactttcgcatctggacaagagatggtagattagatgagattcgtgctaagaatactttagttcgtagagagcaagaactatcttatgaagcagaaacaaaagtagaattctacccaaccaaagatggtgagcaggcaggtttaacttgttattatagtacggccacttatgcaagattttctctttgctatgaaggaggaagaaaacttcagcttgtaataaatcgaaatcatggagaagaattgatggcggaagttctagacatcaaggaaagagcagtttatctaaaagtaatagtggagaagttaacccgtagtttttattatagctacgatggtaaggagtggactttggctggagtattagaaaattgtatttacctttgcgatgagggtgttccagatgatccaaagcgccataccggcactttagtaggcatttatgccaacaacggaggttgcggttctagaataccagcagactttgattatttttattatcaggaa

SEQ ID NO: 73 - DNA, 1908 bp, Clostridium phytofermentans
atgaaattacgcgaggcaatattaaacagagatttagatgttgtgaaggatctattagtaaaggatccaaattcaattgaggataaaactggaggagtatggttaccatttttggcagcatctctaggagatttagaaattgtacggtatattgtagaatattccagagcaagttttaatgaaacagatgaattaaacagaaacgttcttcattatggtgttgaatcaggtaacatttccgttgttcgttacctagtagaaagagttggaatgtcaccggtttctggagatatcaacctagtaacaccatatgaaatagcatacgaaaataaaaataaagaaattcttacttactttgaagaagtttgtggagcaccatatgaacagatgtatcataacccaattcgtaccggtatgcatccagatccatcaatcatttgtgtgggagatgacttttatatggttaactcctcctttatattcttcccttgtattccaatctctcattccaaggacttaattcattggaaagtcattggacatgcaattacaaacccagagtgggcgtacttagatgaactagaaggtggccgtggatattgggcaccagacatttcttattatgaaggaaaatattatattactgcaacctatcgtttaaatgacactggaactgtctatagaaaacaaatggttgtttcttcggataaaccagaaggtccatattgtgaaccagtatttcttgatgaggatggtattgatccatctatctttacggatgacgatggaagacgctatatgttattaaatcgtggagcaagaatatttgagattagtaaagatggaaaaaaacagctttccgaagctacccttttatattatgggcatcaaaagagagcaccggaaggatcgcatttacttaaaaaggacggttggtattaccttttccaagcagaaggtgggaccggtctaggtcatcgtatctctgttgccagatccaaagaactatttggtgtatacaccccatgcccttacaatccgattatgagacagcaggatgaaaagggagcaatcaaacgttgtggtcacggaaaacctgtgaaaactccaaatggtgagtggtatatggtttacttatgtggcagacagttagagggtgaatatagcttacttggacgtgaaacagcactcgatccaattacttggacagcagatggttggccacttgtaaataatctggaaggacctagtgtcctacaaaaactaccaaacttaactccatatattcctgaaccggagtcggatgattttaagaatggtatattaagcagtttatgggtatctcaacgcgtaccagaggagaatgcgtatacatttggcaatggatacttaaagatacagggaagtaaaaaagatttagatacgacagagtcaagaaatattttattacgcagacaacaagattttcactttacgtttgaggtaacagtaggtgatataaaccttaacattggacaggattatggtttaacctgttattatgatgaaaatacgtatcttaaatacggtctcttcgaaacaaaagaaggtttattcttacaggtagtggaacacattgatgaggagacaaagataagcctatcaacaaaggttacaaaaggagagtacagtcttcgcattgtgacagaagggcttaagagaagcttttattatcagagcatagttgatcaggaggaaactaattggcattcccttggtcagcttgatcgagtttattatctatgtgatgaaggtatcaatcgaggaaaacgctttaccggtgctatggtaggtatgtatgctcacgctggtgagaactcctccttaactggtgaatttaaagacattgtatatcaaggtatggaccga

SEQ ID NO: 74 - DNA, 1503 bp, Clostridium cellulolyticum
atgaacaaaataaagatttcagataaggttacaggaagtttcagggataattggaatttctgtgtaggtacagagcgtatggggatcgctcttcaaaaggaataccaggatactctcgagtttgttcagaaggcaataaatttcaaatatatacgaggacatggtctttttcatgatgacactgccatctacagggaatatgaaatagacggagaaatgaaacctttttataactttacatacatagacaggatttttgactcattccttgaaaagggtctcaagccttttgtagagctgggatttatgccgtcacaacttgcatcgggaggacagactgtattttattggaaagggaatgtcactcctccaaaggattatgacaagtggaaaaatctcattcaagctttgataaaacactttataagtagatatggtatagaggaggttctccagtggccttttgaggtctggaacgagccaaatttgaaggtattctggaaggatgccgatgagtccgaatactttaagctttataaggtgtcggcaacagctattaaggaaatcaataaggatttacaggtagggggccctgctatatgcggaggtgccgactactggataaaggattttttggagttctgcaaaagagaaaatgttcctgtagattttgtttcccgccatttatattctgcacatatgccaaaacttcagacacatgaattttgttatcaggatttgaaagaacctgaggaaatgcttaaagaattacagacagtcaggcaaatgattgacaattcaccatttccacacctgccatttcacataacagaatacaacacctcatacaatccattaaaccctgttcatgatacatgtctcaatgctgcgtatctggcacggattataagtgaagccggggatattgtggattcattttcatactggaccttcagtgatgtatttgaagaggcagatgttccaagagctcagtttcacggagggtttggccttgttgcccttaacaatattccaaaacctacttttcatatgttcagcttttttgaacaaatgggtaaggatatattgtacagagatgaaaatatgctggcaacaagaaaagctgacggtacagtgacaataaccgcttggaaccctgtaatggagaaaggtgaccattttaatatggatttctcactggaactgaatctgccaaaaggagaatacttcatcaatcggactattgtaaatgaaactcatggtaatccatggagaacttggatacaaatggggaggcctagattcccgggtaagaagcaggttgaaatattaagaaatgctgcacgccccatggtaatctccgaaagggtaagctgtaccgatgaaatattgcttcttgagtttacacaaagtaaaaacgaggtatcttttattgaaatcattcctgtagcagatgagactaacacttactataaacttgatgacagtttgattcccgggtat

SEQ ID NO: 75 - DNA, 2148 bp, Clostridium stercorarium
atggaaaacaaacctgtttatctggatccgagttattcgtttgaagaacgcgcaaaagatcttgtgtcaaggatgaccattgaggaaaaggtatctcagatgctttacaattcacctgcaatcgaaaggctcggaattcctgcatataactggtggaacgaagcacttcacggtgtggcgcgggccggaacggcgaccatgttcccgcaggctatcggaatggcggctacgtttgacgaagagcttatttataaagtggcggatgttatttcaacagagggcagggcaaaataccatgcaagcagtaaaaaaggcgatcgcgggatatataagggtttaacattctggtcccctaatatcaacatattcagggatccaagatggggacgcggccaggaaacctacggggaggatccttacctcacggcaaggctcggtgttgcctttgtaaaaggcctgcagggaaaccatccgaaataccttaaggctggcggcatgtgcaaaaacattttgccgttcacagtggtccccgaatccttaaggcatgaatttaatgccgtagtgtccaaaaaggatctgtatgagacctatctgccggcttttaaggctttggttcaggaagcaaaagttgaatcggtgatgggagcgtataaccgtacaaacggtgaaccctgctgcggcagtaagacccttctttccgatattctcagaggggaatggggatttaagggacatgtggtatccgactgctgggcaatacgcgatttccatatgcaccatcatgttacggcaacagctcccgaatcagccgcccttgcagtacgcaatggctgcgatctgaactgcggaaacatgttcggaaacctgttaatagcccttaaggaaggcttgatcactgaagaggagatagacagagccgtaacaaggcttatgattacaagaatgaaactgggaatgttcgatcctgaagatcaggtgccttatgcatcgatttcgtccttcgtcgattgcaaggaacacagagagctcgcgctggacgtggcgaaaaaatccattgtcctgctaaagaatgacggcctgttgccgcttgacaggaagaaaatcaggtccatcgccgttataggcccgaatgccgacagccgccaggctctgattggaaactacgaaggaacggcgtcggaatatgtaaccgttcttgacggaatcagggaaatggcaggggacgatgtaaggatttactattcagtcggctgtcatttatacaaggacagagttgagaacctcggcgaacccggggacagaatcgcggaggcagttacctgtgccgaacacgccgacgtggttatcatgtgccttggccttgattcaaccattgaaggcgaagaaatgcatgaaagtaatatatacggttcgggcgacaagcctgatcttaaccttccggggcagcagcaggaactgctggaggctgtttacgccaccggtaagccgattgttcttgtactgcttacaggaagtgctctggcagtaacgtgggccgatgagcatatcccggcaatactgaacgcatggtatccgggggcgctgggaggaagggcaattgcctcggtactgttcggtgaaaccaacccgtcagggaagctgccggttacattctatcgtaccaccgaagaacttcccgactttacagattactcaatggaaaacagaacctacaggtttatgaagaatgaagcgctgtacccgtttggatttggtttgagctatacgacgtttgactacagcgatctgaagctgtcgaaggatacaatcagggcaggggaaggctttaacgtttcggtaaaggtaacgaataccgggaaaatggccggtgaagaagtggtccaggtttacatcaaggatttggaagcaagctggagagttcccaactggcagctttcgggaatgaagagagtaaggcttgaaagcggtgaaactgctgaaattacttttgaaatacggcctgaacagctggctgttgttaccgatgagggaaaaagcgttatcgagccgggtgagtttgaaatttatgtcggcggctcgcagccggatgcaagaagcgtcaggcttatgggaaaagcgccgctgaaagccgtgctgcgcgtgcagtaa

SEQ ID NO: 76 - DNA, 1503 bp, Clostridium stercorarium
atggcaagggaaatcacaataccggctgccggtaagccttttaaaaacaacgccaccttctgcgtgggaagcggaagattaggactggcactgcagaaggaatacatagaccatttgaaaattgtccaggaacgcatccattttaaatatatccgcgggcacgggctgttctgcgatgatgtgggaatataccgcgaaaccgaagaggacgggaagcacgtcgcctactataattttacataccttgaccgcattatagattcttttcttgaacacgatataagaccgtttcttgaattgggatttatgcctgaaaagctgaaatccggggaacagacaatattctactggaaaggaaataccacgccccctgtttcgtatgaaaaatgggccgaacttgtggaaactacgttagcccatcttatcgacaggtatggagcggaagaggttataacatggccggttgaagtctggaatgaacccaatatagctttttgggcgggaacaatggaagagtatttcaaactgtatgagtattccgcaaagcgtgaaagggttgatccgaataaagtcggcgggccggtgatatgtggtatagaaaccgaaaaatggctgcgtgccttttttgagcattgcatagaaaataatttgcctctggatttcgtaagccggcattgttatactgtgggaaagccggtgcgcaaggggcagtttatttatcatgaaatattcagtccaacgtatatgatagaggaattaaaggaaacaagaaaaataatggccgattatccgcagattgctaatctgccgctgcatataaccgaatttaacagttcttacgttcctgtatgcccggtgcatgacacaactttccaggctgcatatattgcgaggattctcagtgaggccggtgaatatgccgattcctattcttactggacattcagtgatgtttttgaggaatatgacgttccaagatcggcgtttcacggaggttttggccttgtggcgctgaattcaattaaaaaaccggtatttcatacttttgaattttttgccaatgcgggcaaggaactgctttaccgcgatgagaatctgattgttacaagggatgacaaaagatatgttataataggctggaactaccatgacacaagaaagggtgagccgggcccggataaagagtatgtactctcaattccctccatcgggcagcaggcaatactgattaaaaagcaggtgggagggaattatgccaatccgctgcagacatggagcaatctgggaaagccacggacgctgaataaggaacaaagaaaaatactgatggcggcgtctgaaccgcttcagacagatgtgaaactgtttgacgaaaagggtttttataaagtgaaactgaccattcagtgcaatcatctgtatatgctggaaattctgcctgttaaggattttaccgatacatatgacggttttgaaccggatgaattttttggacttgaataa

SEQ ID NO: 77 - DNA, 2265 bp, Clostridium stercorarium
atgcaaagggacatcaaaaaaattatttcacaaatgacgctggaagaaaaggcgagcttatgctcggccttggacgcctggaccttaaaaggcgtagaacgtttgggcattccgtccattatggtatctgacggcccccatggtctcagaaagagacaacgggatcccactgatcccggtaagaaaaccactgtcccggccacatgtttccccactgcggtgggccttgcaagctcatggaaccgtgaactggtggagaaagtaggccccgcattgggggaagaatgccaggctgaaggaatagcagtgcttcttggcccgggaaccaatataaaactttcccctctttccggaagaaactttgaatatttttcggaagacccgtacctttcttcggagatggccagaagccatataaaaggagtgcagagccggggagtggggacgtccctgaagcattttgcggcaaataaccaggaacaccgcagaatgagcgtggatgcggtaattgacgaaagaacgctgcgtgaaatttacctcgccagtttcgaaggggcggttaaaaaggcgaagccgtggacgatcatgtgttcatacaacagggtaaacggcgagtatgcatctgaaaataaatttctgttaacagatgtactgagaaatgaatggggttttgaaggcattgtggtatccgactggggagcggtgaatgagagggtaaagggactggaagccggacttgatcttgaaatgccgtcaagcttcggtattggcgaccaaaaaatagttgaagccgtaaagaagggtgagctgcccgaagaggtattggacagaaccgttgaaaggatacttaatttaatttttaaagcggtggataacaggaaagaaaatgccggatatgaccgggaagctcatcacaaactggccagagaagcggcaagggagtgcatggtgctgcttaagaacgaggacaaaatacttccgcttaggaagcagggaaccatagccgtaataggcgaatttgctaaaagaccacggtatcagggcggaggaagctcccatgtaaatccaacaatcatggatagtccatatgaagaaatcaaaaaatcagcgggaaacaatgcagatgttatatatgcgcaaggttatattattgaaaaggacgagccagatgaaaaactcctggaggaagcaaagcagacggcgctgaaggcagatgtcgccgtgatatttgcagggcttcccgagcattatgaatgcgagggctatgaccgtacgcatatgagaatgcccgaaagccactgcacgcttatcgaagaagtggcggaagtaacaaccaatgtggtggtggtattatgcaacggttcaccggtggagatgccatggattgacaaagtgaagggattgctggaggcttacctgggcggacaagccatgggcgggccattgccgatcttctgttcggagacgccaatcccagggaagctcgccgagactttcccgaaacagttaagcgataacccttcatatttgaatttccgggaacgggacagggttgaatacagggaaggcatattcgtgggctacaggtattatgacaaaaagaatatggaaccgctgttcccgttcggatacgggctcagctacactacgtttgagtacggcgatctgaaaataagcaggaaagaaatatctgataacgaaacggtgactgtgagcgtaaaggttaagaataccggagatatggcgggtaaggagattgtgcagctttacgtaagggatattgaaacctcggtaatagaccggagaaggactgaagggtttgaaaaagttgaacttcagcccggcgaggaaaaaacggtggtgtttgaacttgacaagagggcgtttgcttatacacaccggtataaggactggcatgttgaaaccggtgaatttcgagattttataggcagatcctcaagggacatagtgcttaaagacaagatattcgtcaaatcaaccgttaccataaaaaaacggtggacagtaaacacgctggtgggggatttgctttctgatcgggttcttgagcctgtattcagagagtttattattaacgagataaaaacatggtacttgttggatttactggacgaggataatcacctcctgagtgtgtggatgaggtatactcctctgcgttcattggcgaacagtacgggtggggaactgaacgaggaaaagctgaacaggctgattgatacactgaatgcaaatattaaataa

SEQ ID NO: 78 - protein, 366 aa, Pyrenophora tritici-repentis
MLLQAFLFLLAGFAAKISAHHHHHHPPSPPSDDDDKSVAVYDPPVINTFHQCDPAAHVWKHDPNTVYVYGSHDVNSTKNPPVQYDMKDYYVLIQVDITKPATVGPKILDLPDIPWASQQLWAPDVAEKNGEYFLYFPAKDKDGVFRIGVAKSDKPDGKFKAEPSYIPGAYSIDPAILADDDGCYYMYFGGLWGGQLQAWPNNTLNTSAFGNISPSSGPALGPRFAKLSANMTHLATEPKELVIYDKDGQVMQANSTRRYFEAPSINKVGNLYYLQYSTGTSHTIEIAVGKKPEGPFYWKSTLLQPVKGWTTHESIVKFKGDWLLYYADASLTGIDDLRNTKVRKLNFANGTFALAQPQPYTPFPSS

SEQ ID NO: 79 - protein, 804 aa, Aspergillus niger
MAHSMSRPVAATAAALLALALPQALAQANTSYVDYNIEANPDLYPLCIETIPLSFPDCQNGPLRSHLICDETATPYDRAASLISLFTLDELIANTGNTGLGVSRLGLPAYQVWSEALHGLDRANFSDSGAYNWATSFPQPILTTAALNRTLIHQIASIISTQGRAFNNAGRYGLDVYAPNINTFRHPVWGRGQETPGEDVSLAAVYAYEYITGIQGPDPESNLKLAATAKHYAGYDIENWHNHSRLGNDMNITQQDLSEYYTPQFHVAARDAKVQSVMCAYNAVNGVPACADSYFLQTLLRDTFGFVDHGYVSSDCDAAYNIYNPHGYASSQAAAAAEAILAGTDIDCGTTYQWHLNESIAAGDLSRDDIEQGVIRLYTTLVQAGYFDSNTTKANNPYRDLSWSDVLETDAWNISYQAATQGIVLLKNSNNVLPLTEKAYPPSNTTVALIGPWANATTQLLGNYYGNAPYMISPRAAFEEAGYKVNFAEGTGISSTSTSGFAAALSAAQSADVIIYAGGIDNTLEAEALDRESIAWPGNQLDLIQKLASAAGKKPLIVLQMGGGQVDSSSLKNNTNVSALLWGGYPGQSGGFALRDIITGKKNPAGRLVTTQYPASYAEEFPATDMNLRPEGDNPGQTYKWYTGEAVYEFGHGLFYTTFAESSSNTTTKEVKLNIQDILSQTHEDLASITQLPVLNFTANIRNTGKLESDYTAMVFANTSDAGPAPYPKKWLVGWDRLGEVKVGETRELRVPVEVGSFARVNEDGDWVVFPGTFELALNLERKVRVKVVLEGEEEVVLKWPGKE

SEQ ID NO: 80 - protein, 802 aa, Aspergillus nidulans
MRSLISVAVLSALAAFSQANTSYTDYNVEANPDLFPLCLQHLNASFPDCATGPLSLTPVCDRSLSPKDRATALVSLFTFDELVNNTGNTGLGVSRLGLPNYQVWGEALHGVGRANFVESGNFSWATSFPMPITMMAALNKTLIHQIGTIVSTQLRAFSNAGLGGVDVYSPNINTFRHPVWGRGQETPGEDAFLTSVYGYEYITALQGAVDPETSKIIATAKHYAGYDIESWNNHSRLGNDMQITQQELSEYYTPPFIVASRDAKVRSVMCSYNAVNGVPSCANKFFLQTLLRDTFEFSEDGYVSGDCGAVYNVWNPHGYASNEAAASADSILAGTDIDCGTSYQWHSEDAFEDSLVSRSDIERGVIRLYSNLVQAGYFDGEDAPYRDITWDDVLSTDAWNIAYEAAVEGIVLLKNDETLPLSKDIKSVAVIGPWANVTEELQGNYFGPAPYLISPLTGFRDSGLDVHYALGTNLTSHSTSGFEEALTAAKQADAIIFAGGIDNTIEAEAMDRENITWPGNQLDLISKLSELGKPLVVLQMGGGQVDSSSLKDNDNVNALIWGGYPGQSGGHALADIITGKRAPAGRLVTTQYPAEYAEVFPAIDMNLRPNETSGNPGQTYMWYTGTPVYEFGHGLFYTTFEESTETTDAGSFNIQTVLTTPHSGYEHAQQKTLLNFTATVKNTGERESDYTALVYVNTTAGPAPYPKKWVVGFDRLGGLEPGDSQTLTVPVTVESVARTDEQGNRVLYPGSYDVALNNERSVVVKFELKGEEAVILSWPEDTTSDFVSSIDGGLDRKQDVIA

SEQ ID NO: 81 - protein, 328 aa, Cochliobolus carbonum
MSVQAYDPPLISTFHQCDPAAHVWKHDPNTVYIYGSHDWNSTRQPPVQYDMKDYYVLTQTDYTKPATVGPKLLDLVDIPWATQQLWAPDATEKDGQYYLFFPAKDKDDVFRIGVAKSDKPDGKFKPEPNPIAGTYSIDPTILEDNGNYYMVWGGLWGGQLQAWTNNVLNTSLFGNNAPTSGPAIGPRFAKLSANLTSLATTPKELVIYDQDGKVMQAGSTRRFFEGPSLNKVGNLYVLQYSTGTSHTVEIATATKPDGPYYWKSTLLQPVKGWTTHESIVKFKNDWLLYYADASLSGRDDLRNTKVRKILFENGTFKLAQPQPVIPSS

SEQ ID NO: 82 - protein, 335 aa, Penicillium herquei
MDPKPLITHLYTADPSAHVFNGKLYIYPSHDRETDIAFNDNGDQYDMTDYHVFSMDSIDGPVEDSGVVLSAKDVPWVSKQMWAPDAATKNGKYYLVFPARDQEGIFRIGVAISDSPTGPFAPEKNYIPGSYSIDPAVFVDEDEKPYLYFGGIWGGQLQCWEKSGSEVKEGDEMNGLVFNASKSGPQEPSGDGVPALCPRVGQLSDDMLTFVSPPQELQILAPETGEPIAADDHERRFFEAAWMHRYNGQYYFSYSTGDSHYLVYATGSSPLGPFTYQGRILEPVLGWTTHHSIVEFQGKWYLFFHDCELSGGVNHLRSVKVREIVYDAEGKIHLA

SEQ ID NO: 83 - protein, 331 aa, Pyrenophora tritici-repentis
MSVAVYDPPVINTFHQCDPAAHVWKHDPNTVYVYGSHDVNSTKNPPVQYDMKDYYVLIQVDITKPATVGPKILDLPDIPWASQQLWAPDVAEKNGEYFLYFPAKDKDGVFRIGVAKSDKPDGKFKAEPSYIPGAYSIDPAILADDDGCYYMYFGGLWGGQLQAWPNNTLNTSAFGNISPSSGPALGPRFAKLSANMTHLATEPKELVIYDKDGQVMQANSTRRYFEAPSINKVGNLYYLQYSTGTSHTIEIAVGKKPEGPFYWKSTLLQPVKGWTTHESIVKFKGDWLLYYADASLTGIDDLRNTKVRKLNFANGTFALAQPQPYTPFPSS

SEQ ID NO: 84 - protein, 464 aa, Streptomyces avermitilis
MILFALCLAFAGALTTAGPARAAAQTLTNGTQFTDTSGNGVHAHGGGVIKVGGYYYWFGEDRNADNTFKYVDAYRSTDLKNWEFRSHVLTQAGASELASANIERPKVMYNASTGKFVMWMHKENGTDYSEARAAVAVSDTVDGTYTWQGSFQPLGQYMSRDITVFVDTDGTGYMVSAARENYDLQIYRLTADYTGIDSLVADPWHGGHREAPALFKRGGVYFMLTSGATGWNPNQQQYATATSLAGPWTAMTNVGDSTAYGSQTAYVLPVQGTSGTSYLYLGDRWGNSFGGSVNDSRYVWLPLTFPTSTSLSMSWYPEVTVDTVAGTISGTSATYETLTARHSAKCADVPSQSLLTGVALTQYTCNGGNNQKFWFKSVAGGYYELMGRGSSLCLTENVTAVTQENCTAATSQQWSLTTSGGYVSLKSRASGECLDVSGASTANSAALITYTCNGGTNQQWTRGT

SEQ ID NO: 85 - protein, 742 aa, Streptomyces avermitilis
MTHPWQDPALPAAVRAADLLARMTPQEKTAQLYGVWPGSDEAPGGDVAPLQHALSEGVDLAGLLPHGLGQLTRPFGTAPVDPAEGAARLGFLQERIRAANRFRLPALAHEECLTGFTAWQATIFPTPLAWGASFDPDLVKEMAAAIGASMRAVGVHQGLAPVLDVVRDPRWGRTEESIGEDPYLVATVGTAYVQGLQSSGVVATLKHLAGYSASRGARNHAPASLGPRELADVILPPFEMAVREGGARSVMAAYNDIDGLPAHAHHRLLTHLLRDEWQFTGTVVSDYFGVSFLESAHGLADSPAGAAALALAAGVDVELPAVRCFGAGPFDEELVDRAALRVLTQKCELGLLDPDWAPPATEAPVDLDPPHMRALARQLAQESVVLLANDRGLLPLAPGARRIAVLGPHADDPAAMLGCYTFPRHVLLDRPGVPMGVAVPTLLEALRTELPDAEFVTDPAAAEVCVVAVGDRSGLFGRGTSGEGCDAADLELPDGQGEVVDRALASGTPVVLVLLSGRPYALGRWADRCAAVVQAFFPGEEGGPAVAGVLSGRVNPSGRLPVSVPRGPAGQPWTYLAPPLGRHGEASNLDPTPLYPFGHGLSYTTYDWQAPSVDDASFPTDGETTLRLTVRNTGERPGTEVVQLYLHDPVGKVARPVVRLVGYARVPLEPGASGEVHFTVPADLAAYTGPDGERIVEPGALELRLGVSSADGDVRYTVPVTLTGPERVVGRERRLRCEVRVK

SEQ ID NO: 86 - protein, 533 aa, Bacillus subtilis
MKITNPVLKGFNPDPSICRAGEDYYIAVSTFEWFPGVQIHHSKDLVNWHLVAHPLQRVSQLDMKGNPNSGGVWAPCLSYSDGKFWLIYTDVKVVDGAWKDCHNYLVTCETINGDWSEPIKLNSSGFDASLFHDTDGKKYLLNMLWDHRIDRHSFGGIVIQEYSDKEQKLIGKPKVIFEGTDRKLTEAPHLYHIGNYYYLLTAEGGTRYEHAATIARSANIEGPYEVHPDNPILTSWHDPGNPLQKCGHASIVQTHTDEWYLAHLTGRPIHPDDDSIFQQRGYCPLGRETAIQKLYWKDEWPYVVGGKEGSLEVDAPSIPETIFEATYPEVDEFEDSTLNINFQTLRIPFTNELGSLTQAPNHLRLFGHESLTSTFTQAFVARRWQSLHFEAETAVEFYPENFQQAAGLVNYYNTENWTALQVTHDEELGRILELTICDNFSFSQPLNNKIVIPREVKYVYLRVNIEKDKYYYFYSFNKEDWHKIDIALESKKLSDDYIRGGGFFTGAFVGMQCQDTSGNHIPADFRYFRYKEK

SEQ ID NO: 87 - protein, 512 aa, Clostridium phytofermentans
MRQEYCNPVQRGFFPDPSVIRVGDDYYMVNSSFQYFPAIPISHSKDMVHWHIIGHAITNPEYLPLEDIKDSHGIWAPDISYHDGTFYIYATLRLNGSGTRGNNVLRRQLLVTSKTPEGPYSAPTWLEVDAIDPSHFVDDDGKHYMVIAKAATVIPLSDDGKRVIGEPFAAWTGTGECCPEGPHILKKDGYYYAIVAEGGTGYGHGINVARSKNLYGPYEECPYNPVLRQFKEDSPIQRTGHGKLVQTQNGDWWMYYLLGRPNQGRYTTVGRESGLDPVTWTEDGWFIVNEGKGPSERQIAPDLKPHVFERNLKDDFEEEKLNLDWEFVRNPDYGSCSSTERPGYFRIWTRDGRLDEIRAKNTLVRREQELSYEAETKVEFYPTKDGEQAGLTCYYSTATYARFSLCYEGGRKLQLVINRNHGEELMAEVLDIKERAVYLKVIVEKLTRSFYYSYDGKEWTLAGVLENCIYLCDEGVPDDPKRHTGTLVGIYANNGGCGSRIPADFDYFYYQE

SEQ ID NO: 88 - protein, 636 aa, Clostridium phytofermentans
MKLREAILNRDLDVVKDLLVKDPNSIEDKTGGVWLPFLAASLGDLEIVRYIVEYSRASFNETDELNRNVLHYGVESGNISVVRYLVERVGMSPVSGDINLVTPYEIAYENKNKEILTYFEEVCGAPYEQMYHNPIRTGMHPDPSIICVGDDFYMVNSSFIFFPCIPISHSKDLIHWKVIGHAITNPEWAYLDELEGGRGYWAPDISYYEGKYYITATYRLNDTGTVYRKQMVVSSDKPEGPYCEPVFLDEDGIDPSIFTDDDGRRYMLLNRGARIFEISKDGKKQLSEATLLYYGHQKRAPEGSHLLKKDGWYYLFQAEGGTGLGHRISVARSKELFGVYTPCPYNPIMRQQDEKGAIKRCGHGKPVKTPNGEWYMVYLCGRQLEGEYSLLGRETALDPITWTADGWPLVNNLEGPSVLQKLPNLTPYIPEPESDDFKNGILSSLWVSQRVPEENAYTFGNGYLKIQGSKKDLDTTESRNILLRRQQDFHFTFEVTVGDINLNIGQDYGLTCYYDENTYLKYGLFETKEGLFLQVVEHIDEETKISLSTKVTKGEYSLRIVTEGLKRSFYYQSIVDQEETNWHSLGQLDRVYYLCDEGINRGKRFTGAMVGMYAHAGENSSLTGEFKDIVYQGMDR

SEQ ID NO: 89 - protein, 501 aa, Clostridium cellulolyticum
MNKIKISDKVTGSFRDNWNFCVGTERMGIALQKEYQDTLEFVQKAINFKYIRGHGLFHDDTAIYREYEIDGEMKPFYNFTYIDRIFDSFLEKGLKPFVELGFMPSQLASGGQTVFYWKGNVTPPKDYDKWKNLIQALIKHFISRYGIEEVLQWPFEVWNEPNLKVFWKDADESEYFKLYKVSATAIKEINKDLQVGGPAICGGADYWIKDFLEFCKRENVPVDFVSRHLYSAHMPKLQTHEFCYQDLKEPEEMLKELQTVRQMIDNSPFPHLPFHITEYNTSYNPLNPVHDTCLNAAYLARIISEAGDIVDSFSYWTFSDVFEEADVPRAQFHGGFGLVALNNIPKPTFHMFSFFEQMGKDILYRDENMLATRKADGTVTITAWNPVMEKGDHFNMDFSLELNLPKGEYFINRTIVNETHGNPWRTWIQMGRPRFPGKKQVEILRNAARPMVISERVSCTDEILLLEFTQSKNEVSFIEIIPVADETNTYYKLDDSLIPGY

SEQ ID NO: 90 - protein, 715 aa, Clostridium stercorarium
MENKPVYLDPSYSFEERAKDLVSRMTIEEKVSQMLYNSPAIERLGIPAYNWWNEALHGVARAGTATMFPQAIGMAATFDEELIYKVADVISTEGRAKYHASSKKGDRGIYKGLTFWSPNINIFRDPRWGRGQETYGEDPYLTARLGVAFVKGLQGNHPKYLKAGGMCKNILPFTVVPESLRHEFNAVVSKKDLYETYLPAFKALVQEAKVESVMGAYNRTNGEPCCGSKTLLSDILRGEWGFKGHVVSDCWAIRDFHMHHHVTATAPESAALAVRNGCDLNCGNMFGNLLIALKEGLITEEEIDRAVTRLMITRMKLGMFDPEDQVPYASISSFVDCKEHRELALDVAKKSIVLLKNDGLLPLDRKKIRSIAVIGPNADSRQALIGNYEGTASEYVTVLDGIREMAGDDVRIYYSVGCHLYKDRVENLGEPGDRIAEAVTCAEHADVVIMCLGLDSTIEGEEMHESNIYGSGDKPDLNLPGQQQELLEAVYATGKPIVLVLLTGSALAVTWADEHIPAILNAWYPGALGGRAIASVLFGETNPSGKLPVTFYRTTEELPDFTDYSMENRTYRFMKNEALYPFGFGLSYTTFDYSDLKLSKDTIRAGEGFNVSVKVTNTGKMAGEEVVQVYIKDLEASWRVPNWQLSGMKRVRLESGETAEITFEIRPEQLAVVTDEGKSVIEPGEFEIYVGGSQPDARSVRLMGKAPLKAVLRVQ

SEQ ID NO: 91 - protein, 500 aa, Clostridium stercorarium
MAREITIPAAGKPFKNNATFCVGSGRLGLALQKEYIDHLKIVQERIHFKYIRGHGLFCDDVGIYRETEEDGKHVAYYNFTYLDRIIDSFLEHDIRPFLELGFMPEKLKSGEQTIFYWKGNTTPPVSYEKWAELVETTLAHLIDRYGAEEVITWPVEVWNEPNIAFWAGTMEEYFKLYEYSAKRERVDPNKVGGPVICGIETEKWLRAFFEHCIENNLPLDFVSRHCYTVGKPVRKGQFIYHEIFSPTYMIEELKETRKIMADYPQIANLPLHITEFNSSYVPVCPVHDTTFQAAYIARILSEAGEYADSYSYWTFSDVFEEYDVPRSAFHGGFGLVALNSIKKPVFHTFEFFANAGKELLYRDENLIVTRDDKRYVIIGWNYHDTRKGEPGPDKEYVLSIPSIGQQAILIKKQVGGNYANPLQTWSNLGKPRTLNKEQRKILMAASEPLQTDVKLFDEKGFYKVKLTIQCNHLYMLEILPVKDFTDTYDGFEPDEFFGLE

SEQ ID NO: 92 - protein, 754 aa, Clostridium stercorarium
MQRDIKKIISQMTLEEKASLCSALDAWTLKGVERLGIPSIMVSDGPHGLRKRQRDPTDPGKKTTVPATCFPTAVGLASSWNRELVEKVGPALGEECQAEGIAVLLGPGTNIKLSPLSGRNFEYFSEDPYLSSEMARSHIKGVQSRGVGTSLKHFAANNQEHRRMSVDAVIDERTLREIYLASFEGAVKKAKPWTIMCSYNRVNGEYASENKFLLTDVLRNEWGFEGIVVSDWGAVNERVKGLEAGLDLEMPSSFGIGDQKIVEAVKKGELPEEVLDRTVERILNLIFKAVDNRKENAGYDREAHHKLAREAARECMVLLKNEDKILPLRKQGTIAVIGEFAKRPRYQGGGSSHVNPTIMDSPYEEIKKSAGNNADVIYAQGYIIEKDEPDEKLLEEAKQTALKADVAVIFAGLPEHYECEGYDRTHMRMPESHCTLIEEVAEVTTNVVVVLCNGSPVEMPWIDKVKGLLEAYLGGQAMGGPLPIFCSETPIPGKLAETFPKQLSDNPSYLNFRERDRVEYREGIFVGYRYYDKKNMEPLFPFGYGLSYTTFEYGDLKISRKEISDNETVTVSVKVKNTGDMAGKEIVQLYVRDIETSVIDRRRTEGFEKVELQPGEEKTVVFELDKRAFAYTHRYKDWHVETGEFRDFIGRSSRDIVLKDKIFVKSTVTIKKRWTVNTLVGDLLSDRVLEPVFREFIINEIKTWYLLDLLDEDNHLLSVWMRYTPLRSLANSTGGELNEEKLNRLIDTLNANIK

SEQ ID NO: 93 - DNA, 1389 bp, Trichoderma reesei
atgacaccacacagcatcgatagagccgcaagaccttccgtatggtctggtctagccttattacttagtacggcccacgccatagtgatgcctgatggagttacaggtaaagtgccatcattgggttggaatagttggaatgcctaccactgcgatatagacgaatctaagtttttgtctgccgctgaagtaattgtttcctccggtttgttagatgctggatacaattacgtgaatatcgatgattgctggtcaatgaaggacgggagagttgatggtcatatagcggttaatacaacaagatttccagatggaattgatgggttagcgaaaaaggttcatgacttgggactgaagctaggcatctactctacagctggaactgctacttgtgctgggtatcctgcttctcttggttatgaagatgtagatgcagccgactttgcagactggggagtagactacttgaagtacgacaattgtaatgtgccttctgattggcaggatgaatatgttgcttgcgcaccagacgctgtccaaacgggtccaaacggcacctgttctactgccttggaaccaaatcttgcaccaccaggttatgattggtctacctcaaaatcagctgaacgattcaatgctatgcgtaacgcattagcaaaacagtctagggaaatcgtcttgtcactgtgtatttggggcgtcgcggatgtattttcctggggtaatgaaacaggaatatcttggagaatgtcaggtgatattagtccagaatggggctcagtgactcatatcatcaacatgaattcctttaagatgaactcagtcggattttgggggcacaacgacgctgatattttggaagttggtaatggtaacctcactgcagctgagactagaactcatttcgcattgtgggctgcaatgaaatcacctctactaattggcactgacttagctcaactgtctcaagagaacattgagctacttaaaaacaagcatctcttagccttcaaccaagattcagtttacggtcaaccagccactccttacaaatggggcgtcaatccagactggacattcaactacaccaatcctgcagaatattgggctggtccaagctctaaaggccatctcgtgcttatgatgaatacactagatcatacagtcagaaaagaggcaaaatggagtgagatccctggcctgtctgcaggtagatacgaagtaagagatgtttggaccgataaaagcttgggttgtttgtctagttacaagacagcggttgctgctcatgatacagcagttatcttagtcgggaaaaagtgtcgtaactgggatgatgatgatgacaaaggtggttctcctccttctcatcatcaccaccaccactaa

SEQ ID NO: 94 - DNA, 1338 bp, Trichoderma reesei
atgaccccacattctattgatagagctgctagaccatctgtttggtctggtttggctttgttgttgtctactgctcatgctatagttatgccagatggtgttactggtaaagttccatctttgggttggaactcttggaatgcttatcattgcgatattgatgaatctaagtttttgtctgctgctgaagttatagtttcttctggtttgttggatgctggttacaattacgttaacattgatgattgctggtctatgaaggatggtagagttgatggtcatattgctgttaacactactagatttccagatggtattgatggtttggctaaaaaagttcatgatttgggtttgaaattgggtatctattctactgctggtactgctacttgtgctggttatccagcttctttgggttatgaagatgttgatgctgctgattttgctgattggggtgttgattatttgaaatacgataactgtaatgttccatctgattggcaagatgaatatgttgcttgtgctccagatgctgttcaaactggtccaaatggtacttgttctactgctttggaacctaatttggctccaccaggttatgattggtctacttctaaatctgctgaaagattcaatgctatgagaaatgctttggctaaacaatctagagaaattgtcttgtctttgtgtatttggggtgttgctgatgttttttcttggggtaacgaaactggtatttcttggagaatgtctggtgatatttctccagaatggggttctgttactcatattatcaatatgaactccttcaaaatgaactctgttggtttttggggtcataatgatgctgatattttggaagttggtaatggtaatttgacagctgctgaaactagaactcattttgctttgtgggctgctatgaagtctccattattgattggtactgatttggctcaattgtctcaagaaaacatcgaattattgaagaacaaacatttgttggctttcaatcaagattctgtttatggtcaaccagctactccatacaaatggggtgttaatccagattggacttttaattacactaatccagctgaatattgggctggtccatcttctaaaggtcatttggttttgatgatgaacactttggatcatactgttagaaaagaagctaagtggtctgaaattccaggtttgtctgctggtagatatgaagttagagatgtttggactgataagtctttgggttgtttgtcatcttacaaaactgctgttgctgctcatgatactgctgttattttggttggtaagaagtgtagaaattggtaatga

SEQ ID NO: 95 - DNA, 948 bp, Streptomyces avermitilis
atgccagaaaggcagtccgagcccactccggacgagtccgccccccgcccgtggagccccttcgcgagttcgccggcgtccgaaccgtcccaccccgggcatctgccgctgccgacggaggagccgccgacgccgtggcagccgggcggtacgccggacacctcccgcgtacccgggacccgacggctctggctggccggcgccctcgccctggccaccgtcgtcgcctgcgtgaccgcgctcaccacgacggaccacgcggccgacacctcggccgcgaaggaagccgacaccaagctggactcggccgaccccggtctcctcacgttcgcctccccctccgcggggccgagtacctaccccggcgccaagagcggccggtcgagcgagcgagccgcgcagaccactcccgacggctccgcctcggccgaccccgcccggcacggctccgcgtcgaagcccgcggccgagcggtcgaagccggcctcgtccaccggcacgtcctcgggctcgaagccctccgccgtgtggaagtccgtccggtcggtcaactaccccgaccgctactggcatctcggcggtgacaccggccggctcgaccccgtgagctccggcagctcggccacgaccaggcaggacgccaccttcaaactggtcaaggggctcgccgacgcgtcctgctactcgttcgccaccgcggacggcacctacctgcgccactcccggttccgcctgcgcgccgaccgcaacgacggcaccgcgctcttcaagaaggacgccaccttctgcccccgcacgtcgtcgtactccggcgccgtcatgctggagtcggtgaactaccccggccgctatctgcgccacaaggacttcctgctccgcctcgacccgtacgagaacaccggccagtaccgggccgactccgcgttccagctggtgaagggctgggac

SEQ ID NO: 96 - DNA, 1608 bp, Streptomyces avermitilis
atgaccgtcccgccatccttcctgagacccctgagcgccgccttcgcgatgctgcttctgctggtcctcgctccggccctgctggtgctccgcgcggcaccgcccgcgcaggccctcgacaacggtctggccaggacgcccccgatgggctggaacgactggaacgccttcggctgcaacgtcaccgagcagttggtcaagcagaccgccgactacctcgtctcctccggtctgaagggcgccgggtaccagtacgtcaacatcgacgactgctggatgacctcggcccgcaactccgtgggccaactggtgcccgacccggtcaagttccccgacggcatcagcggaaccgccgcctacgtccacagcaagggcctcaagctcggcatctacgagagcgccggcaccgccacctgtcagggctaccccggaagcctcggccacgagcagacggacgccgacagcttcgcctcctggggcgtggactacctcaagtacgacaactgcaaccaccagaacgtgcccgaccagcagcgctacaccgccatgcgcgacgccctggtcaacaccggccgcccgatcgtctacagcctgtgcaactggggtctggccagtgtgtggacctggggagcgggggtcgggaacagctggcgcaccaccgacgacatcaacgtcaacttctcgacggtggtgtcgatctacaaggccaacgtcaagctcgctccgtacgccaagccgggcgcctggaacgaccccgacatgctcgaggtcggcaacggcatgtcgttcaccgaggaccgttcccacttcagcctctggtcggagatggccgcgcccctgatcgccggaaccgacctgcgcaaggcctccgccgccaccctcttcctctacggcaacaaggacgtcatcgccgtggaccaggactccctgggcaagcagggcaccgaggtgtcctcctccggcggcctccacgtgctgaccaaaccgctggcgaacggcgacgtgtcggtggtgctcttcaacgagaactcctccgccgccaccatcaccacctccgccaccgcggccggtctccccgcggcatcctcctaccggctcgacaacctctggtcacacgtcgtcagcagcaccggcggaagcatctcggccagtgtccccggccacggctccgtgatgtaccgggtctccgtcggcagtggcaccagcgccgggagcacccacccgctggtcggcgcctcctccaaccgctgcctggacgcgtacgacaaccagaccgcccccggcaccaagatcgagatctgggactgcggcggcgccaaccaggccgtgaccatcaccgccgccggtgaactccggctctacggcggcacccagtgcctggacgcctacgacaacgggaccacttccggcaccaaggtgcagctctacacctgcaacgggggagccaaccagaagtggagcctcaaccccaacggcaccgtcaccggcacccagtcaggcctctgcctcgacgtcacgggcggcgaccaggcctccggcaacgtcaacggcaccgcgctcgaactctggacctgcaacggcggcgccaaccagcagtggcgcctgggc

SEQ ID NO: 97 - DNA, 1824 bp, Streptomyces avermitilis
atggggtcatcctcgtacgccgtcatacccggagccgccccgcgctccggccgccgctccataagagccgtcctcgtcctcgccctcaccgcgggtgtcgcgacggtcgtcccggccgcccaggcggacacgagcacgcccgccgccgctccggtcgccgccaagccgtacatgggctggtcgagctggagcatgcagtcgtcgaagtacccgggcctcaacccggacggcgactacagctatctcaccgaggcgaacgtcctgaagcagacggacgccctcgcctcgaagctgaagaagtacggctacgaccacgtcaacatcgacgccggctggtggatggacaagaactggaagacccagttcgaccagtacggccggcagacgcccgacccggtccgcttcccccacggcatgaagtcggtcgccgaccacatccactccaagggcctcaaggcgggcatctacctgcccgtcggcctggagaagggggcgtacggcgacggcaagacgccgatctcgaaggcccccggctgcaccaccgccgacatcgtctactcggacctgcgcaccaccaacggctgggacaacgcctacaagatcgacttcgacaagtcctgcgcgcagaagtacatcgactcgcaggcgcagatgttcgcggactggggctacgacttcctcaagctggacggggtgggcccgggctcgttcaagtccggtgacaactacaacaacgtcgccgacgtcgccgcctggcagaaggccatcgccgccaccggccgcccgatccacctcgagctctcctggtcgctcgacatcggccacgccgccgactggaagaagtactccaacggctggcgcatcgacaccgacatcgagtgctactgcaacaccctggtcacctgggagaactcggtcaacgaccgatgggacgacgccccggcgtggagcagcaaggcgggccccggcggctggaacgacctcgacgccatcgatgtcggcaacggcgagatggacggcctcaccaaggccgagcggcagagctacatgacgctgtgggccatcaacaagtcgccgctgttcaccggtgacgacctcaccaagctggacagctacggcgtctccctgctcaccaacaaggaagtcatcgccgtcgatcagaacacctcgcccgtcgcgcgtccggtcaccccggtcggcgaccagcaggtctggggcaccaagaacgccgacggcagctacaccgtcgccctgttcaacctcggcgactcgccggcctccgtcaccgcccactgggcttcgttcggattcaccggcaacgcctccgtgcgtgacctgtggaacaagacgaacctcgggacccacaagaacaagatcaccgaggcgctgcccgcacatggctcgcggctgttcacgatcaagcccggcggcggcaccctggcgaccacgggctacgaggccgaggccgcggccaacaccctgtcgggcaacgcctccgtcggcggatgtgacgcctgctccggcggcaagaaggtcggcaacctgtacaccggcggcaagctgcggatcaacgacatcacggtgaagaaggacgggatctacaccgtcaaggtcgcctacgtcagcggcgacccccgctcggtgaccgtcctgtccaacagcggtaacggcacgagcctgaagttcccctccacgggcgactggagcacggccgagaccgtcagtgtccaactggcactgaaggcgggctcgaacaccatcacgttcgacagcggcagcggatacgcacccgacatcgacaggatcgtcgttccgcagtccgtc

SEQ ID NO: 98 - DNA, 2046 bp, Streptomyces avermitilis
atgcgtcacccctacgcccgcacaacccgcacaacccgcacaacccgcacaacccgccgaagagtcgtcggagcgctcaccgcaggactgttgtgtacggccgggctcgcggcgccggccctcgccgctcccgccgccggtccggtctcgccccggccggccgacagcctcgccctcaccccgccgatgggcttcaacaactggaactccacgggatgccgaccggagttcaacgaggacatggtcaaggggacagccgacatcttcgtcgagaagggtctcaaggacgccgggtaccagtacgtcaacctggacgattgctgggccctgccggcccgggactcgaacggcaagttggtgccggatcccgctcgattcccgggtggaatcaaggcggttgccgactatgtgcactccaaagggctcaagctcggcatctacaccagcgcgggcaccaagacatgcaacgaagccggtttcccgggcgcgctgggccacgagtacagcgacgcccaacagttcgcggactggggcgtcgactacctcaagtacgacaactgcaacaaccagggtgtcgacgcgaagctccgctacaccacgatgcgtgacgcgctgaaggccacggggcgccccatcgtctacagcctctgcgagtggggcgagaacaagccctgggagtgggcgtcggacgtcggacagctgtggcgtacgaccggggacatcagcgacagttggggctcgatgctgtcgatcctcaagcagaatctgcccctcgcgccgtacgccggtcccggccactggaacgacccggacatgctggaggtcggcaacagcggcatgaccgacaccgagtaccgcacccacttctcgatgtggtcgatcatggccgcgccgctgctcatcggctcggacctgcgcaaggcgtccgccgcgaccttcgacatcctcgacaacaaggaggtcatcgccgtcgaccaggacccgctgggcaagcagggcacggtgctctcctccgagggcggacgctgggccgtcaccaaggagatgaaggacggcagccgggcggtggccctcttcaacgagacggacagcgcacagcggatcaccaccaccgcgcaggccgtaggactgccgaaggcacacgcgtacacgctgcgcgatctgtggcagcacaggagctacaacaccgccggcacgatctcggcgaccgtcccggcgcacgggacggtcctcgtacgggtctcggccgacgccgcatgggccaagaacccgcccgccgtcgaactgggcgtggacggcagcccgttgctggaggcgggcaggacggtcgccctgacctcggcgctcaccgacctcggccgtacgcccgcgaagcgtgtctccgtgacactgagcgggccccgggggtggcgggtgagggcgacctcgccgaccaccgcgggcacggtgccgacaggccgttcgctgcgcacgaagtggaaggtcaccgcgcccgacggcacggccgccggctcgtacgacctgacgctgaaggcgacctaccgctcgccgacgggggtacgcgccgagaccctggtgccgctcgcggcgtccgtggtgccggccccgccctcgggcgtctcctacctcggggacctgccctggatgtcgacgaccaacggctggggcccggtggagcgcaacaccagcaacggtgagagcgccgccggcgacggtcgtccgatcactgtcgacggcgtcgtccacgccaaggggatcggtgtgcacgccgagagcaccatcgcgtactacaccggcaggtcgtgcgagacagtcaccgcggacgtgggggtcgacgacgagcaggacaccaatggcagcgtcaccttcgagatctgggcggacggcaccagagtcgcctcgaccggggtcctgaccaccgcgatgccggcgcgaccgctctcggccgatgtgaccggcgcccaggtggtccggctggtcgtcaccgacggcggcaacggcatcacctcggaccacgcggactgggcggacgccaagctcagctgc

SEQ ID NO: 99 - DNA, 2454 bp, Clostridium phytofermentans
atgatttcctttgaaaatgatgtcttttggctagatacggatactacctcttatgtgtttcgtattactccatatggacaccctgaacatatttattatggacgtaaactggcacatcagccggtggatgctcttgcactgaaacgaacagctactatcggttcatccgtactatatgagccaaacgatccgctgtattgtcttgaccatcttagcttagaatggtccggtatcgggcggggcgactaccgtttcagcccagctgaaatcaaaatgccagacgggagttttaccaatgattttatttacgattcttatcgtatcatggatggctgcactccgatggaagaattaccttttgcaaaatctgaagatgcgcagacacttgaaattgttctggtagataacgttggacatgcaactttaagtctttattacactgtattttcacagaccgatgtaattacacgccgttgtaccttaagaaatcagggaccgaattttcaaaataaatctcattccttacagcaaaacgatgagcaaatatcgacactccaagattctcaaagccacttggaagtaaagaattcctgtgaaaatgagcaacataaagaaagtcccatcgttatccgccgtcttatgagtatgatggtagacctcccaaatcaaagctatcaactaattacctttgacggagattggattaaagaggcacatcggcatgatcgtctgttaatgccaggaatgtatgtaaatggttctgttaccggaacaagctccaatcgtcataacccaggatttctcctcgccaatgaacgtgccgatgaaactcatggtaatgtttatggttttaatctgatttacagcggtaatcattttggaggtgcggaactatctccccatggtttggtacgtgttacacttggtattaacccccactgttttgaatgggtattaaatcctggagaatctttttctacccctcaagcagtgatgactttctctgatcagggattccatggtatgagtcgacattttcatgattttattaaccagcatatcgtaccagaatattggcaaaacagagagcgcccgattctctacaacagttgggaagcttatttttttaaatttaaccaacgaaaactattacataccgcaaagcacgcccgttctcttggcatggagctttttgtattggatgacggctggtttggcaagcgtaacaatgacaatgctggacttggtgattatgaagtaaataaaaagaaattccctcatggaatatccgcattttcccgtaaaatccgtaaaatgggtatggaatttggcttatggtttgagccagagatggtaaatgaggactcagacctataccgaaaacatccggattgggcggtacatacgccacgtaggaatcctacctatggcaggaatcagttggttcttgatttgtgcaatccgaaagttagggattatatcgtagaatccgtggggacggtattagatgatgcggaagtatcttatgttaaatgggatatgaaccgacacatcagcgacgcttattctaggttgctttcagaacagggggaattctttcaccgatacatcttaggattatatgagatactgaaacgaatctttgccccgcgcccccacatcttgttggaaacctgctccagcggtggcaaccgttttgaccttgggatgctttgctttggtccgcaaatctgggtttccgactgtactgatccagtagaaaggctttccattcaaggcggattatcttttctctaccctccctctacttttggcgctcacgtgtccgaagcaccacaccagcagaccttgcggcagacgccccttgctacccgctttcataccgcctgctttggatgcttgggctatgagcttgagttaaaatacctttcaaaaatagagcgttcagaaattcgggagcaaatagcattttataaattgcaccgccctaccctacagtttgggaaattccgccgcttagagcctataaaatcaaacatcatccaatggcaatgtaccgaaaaggatgaaagtaaagcaatcgcagggtattttcaaaccttggcaaatgccaatccagaacatgatattcttatcgtgtcagatttaaatgaaaaatataactatcaggttactacgaaacgtcagcgtctgtttatcaaacgatttggaggactgattaaacacgttcttcctgtatcactaaatccggacggttttttattaagactggtcaaccgtttctatgctctcctcgactgtacagaagaatatattggagatggccgcctgcttggaagtgggattcttttaaacaaccagtttatgggaagttattataattttgaaactaggttactgggagatttcggctctaatctctacctaattaaacaaatggaaagtgaggtttcc

SEQ ID NO: 100 - DNA, 1383 bp, Aspergillus niger
atgcggtggcttctcacctcgtccgcactgttagtgccggccgcagccttggttagacctgacggagtcggcttaaccccagctttaggatggaactcatggaatgcctactcttgtgatattgatgctgacaaaatagtcactgcagctaatgaggttgttaatttgggtttaaaagatttgggctacgaatacattaacatcgatgactgttggtctgttaagtccgggagaaacactactacaaagagaatcatccctgatccagacaaattcccaaatggcatttcaggggttgcagatcaagttcatgccttggggttgaaattaggcatatactcatcagccggattgacaacttgtgctggttatccagcttctcttgggtacgaagagatcgacgcacaaagtttcgctgaatggggtatcgattacctaaagtacgataattgtggtgtccctacaaacctaacggatcagtatacttattgtgttcctgatagcactgatggttcaaattatccaaatggtacctgcgtaaacttaactgatgctgcaccacagggctacgactgggcgaccagtacaacagctaagagataccaacgtatgagagatgcgcttttgtcagttaatagaaccatactatactccctatgcgattggggtcaagcagatgtaaacgcttggggaaatgctacaggcaattcatggagaatgagtggtgacatcacagctacttggtctaggattgctgaaatagcaaacgaaaacagctttctgatgaattacgcgaacttttggggatatccagatcctgatatgttagaagtcggaaatggaaatcttacattaccagaaaacagagcacatttcgcactgtgggcaatgatgaaagctccattgatcattggtactcctctcgattctatcgacacatctcatctcacaattctgtccaataagccattgcttacgtttcatcaagacgctgtgattggtaggccagcttatccatacaaatggggttacaatccagattggacttttgacccagagcatcctgccgaatactggtctgggccaacatcttctggagaagtctttgtccttatgttaaactcagagggagaagtaaagacaagatcagccgtttgggaggaagtaccagaattgaaagacagaggcactaagaaaaattccaaagagaaaaagggcttcaaagtgacagatgcctggactggcaaggatctaggttgtgtaaaagacaaatacgaagttaagctacaagctcatgatgtagccgtgttggtggttggtggtcaatgcgatgatgatgacaaaggtggttctcctccttctcatcatcaccaccaccactaa

SEQ ID NO: 101 - DNA, 1929 bp, Talaromyces stipitatus GH31
atgaactatataatagacgatctcgacaaaatggccagactctttgccactgccattgccattacaggtgctcttgctcaaactaattgtacaggctctagttacgttcctggttctgttaatttcacactagaatgttacaacgcaatacaaaattgtgtctcaaagtttgaggctaacgcttctctggtagattgcaatgatggccagggtaacatctacatgcaacaacaagcctcattgacatcaacctcaccaaattccgatattgtcatcgctttccaagatatcctcgaactttgcatactatctggatctaccagcggcacgtggggctattccgacaatcaatggtactggaccgctgcggaaccagcatgttacgtcgattcaacaacagatgtagttcctacaaggccagccccattctgtatacaagaccgtgactcatctttgcctgactgctatcctcagccaaaatcaatagctagttccgcaaataagtttaaagtcttaaaaacttctggttcaacacctaatggcttcaatagttcagccagaggatggaacacgtacggtattcaagcactatctaatggttctgaagtggtaccatcatttgttggtagttctggacttaactacttacaggaatttgtcaagacacaatgtggggttttagctcaaagtggatttcaacaagcgggatacgtttactgttcattggattcaggttggcaaactcaaacaactgatgagtatgggagaatcgtgtacgattctaccagattcaatctccctcaattggcatcatggttgcatggacaaggcctgaaacttggtgtttatgttgttccaggagtgccatgcagtgctgcgaataagactattaaaggtactaatatctctattaatgatgcattgaacggtaataacgatcaactgtactgttcctggaactttagtaaggatggagtacaggagtggcatgactcagtggttgctcagtgggcaagctggggtgttgatatgattaaactagacttccttacaccaggtagtccacaaaatggtgctaatttggactgcgattcatccgacgctgcccatgcttacttgaatgcaatcaaggcgtctggtagacacatgagattggatctgtcttggaaattgtgtagaaatgaaacatggctaccaatatggtcccagttaggcgattcaatgagaattgaccaagatttggataactacggttacaacacatttgtggcttgggcgactgcccaaagagcaatcgacaattacagacaatacatcggactacaggctcagagaaatgtcccattaaccacttacccagatatggataacttgtttacagcaaacgccgagaacttaactggtgtcccagacttacaaaggatcaccatcatgaatcattggttaggggctggagccaatcttattctcggaggggatttgacagcaattgactctttaggctatcagttgctaacatctgcagaatccatcgctgcagctgactttttctctcaataccctatgcaaccacgaaacccaagcacaggtgataacttagcacaacaactgcaggcctggatcgcaggcccatccgatgattctatcgcttatgtgttgctagtgaactatggccctgaccaaggacaaggtggttttggcacacaacttaagggtatccaagatgtaacggtttcattagaagatttgggcatttcaggctcctcttggcacgctactgatctttggaatgggactgctacgaaaattactgattcctacacagtagcattggacgaaggtgcttctcaattattgagattaactactgcttctgatgatgatgacaaaggtggttctcctccttctcatcatcaccaccaccactaa

SEQ ID NO: 102 - DNA, 1227 bp, Aspergillus niger
atgatgaaacgcaaatctcagctgtcatcattcaccttagtgacggcggcaattttaccttttgcccattttgtgatgggaggcacaagtctcgcacagaagccacaaatgggttggaatagctggaatgcctttaaagctacagtcaattacactatcgttcaggaggttatttccctgtttgatacgttaggactaaaggaagccggatatgaatacgttctactggacgatggttgggcatcttacaatagaacatcagatggttacctacaagctaatgcgacttcatttccacaaggcataaaggctttggcacaagaggtacatggtaaaggtcttaagttaggcttgtacggcgactctggacattacacttgtgcttggcgtccaggctcttggggttacgaggaaagagatgcacaaacatttgccggttggggtgtcgattacctaaaatacgacaattgtgggggctttcaaagtatgaccgaagcccctcaaattaggttcggtgcaatgaaaaatgccttaactttgtctggtagagatatattctattccgtatgcggctggggatatcaatttccttggcattggggtggcgatatcggtcatagttacagaatgtccggagacattactacttcattcacaaacgaaaccgaatgccaatgtaagaccgcttattgtttgaatacaggacaataccaaactccagggcattggctggatatggacatgttagaagttggtaatgctaacttcacacttaatcaacaacaaactcattttgctttttgggctgcactgaaatcaccactaatcataggggcagacttgagcaaattgagtaacgattctcttgctgttctcacaaacaaggccatcatttctatcaaccaggatgcattgggggaaccagtaacttatagagaagctcactccaaagagggtttgttccaagtttgggctgggaaggtcgaagatggctacgtggtattgctccttaacgaaaaatcatacccacaaacagtttcattgtcattcgcatctttaggtttgggatctccacagaaagtcacagagttatggtctggacaaacattgcaggatcttagtatgatatccgctaatccacaatctagacaaattgacatcctaaacatcaaggatgatgatgacaaaggtggttctcctccttctcatcatcaccaccaccactaa

SEQ ID NO: 103 - DNA, 2295 bp, Metarhizium acridum CQMa 102
atgggacaagtgccggctctttgtaggttgactgtcttgctcctggtcgctggcatggcgtcggctgcgagtgctcaaggtggctcacaaaaacctatcgaagttgatggtacgacattcgctcttaatggggataatgtctcctacagatttcatgtagatactacaactggcgacttgattggcgatcactttggcggacctgtagagtcagatacaatagaagctgaaatcggtcctgttcagggttgggtagacatgatcggcagagttagaagagaactcccagacttgggtagaggtgactttcgaacaccagttgtacaaattagacaatctgaagggtacaccgtgtctgattttcagtaccaagggcatactgttctagaaggcaaaccagcattgaatgggcttccatccacattcggaaaggatgaagatgtgtctactttagtagtacatctttatgataattactcttccgttgctgcagaccttggttactccatttttccaaagtacgacgccattgtccgttctgtgaacatcacaaattctggcgagggaaacattactatcgaaaaattggcatcttttagtgttgatctgccttggggtgattatgatatgttggagttgaagggggattgggctagagaaggtatgagaatacgtcgtaaaattgactttggaatccaaggattcggttccactacaggatacagttctcatctgtataatccattcctgagcgtcgtatccggagctactactgaatcacatggggaagcatacgggttttcacttgtctatacaggctcattttcagcagaagttgaaaaatcttctcagggcctcaccagagcaatgctgggtttcaacccatcccaattagcttggccattaggaccaggtgaatctctccaatctccagaatgcgtggcaatcttttcctccactggtattgggggaatgagtagaaaattgcatagtttatacagacaacacttaatgaagagtaagtacgctacagaaacaagaccagtcctacttaattcctgggaaggtttaggtttcaactataacgccagtacaatatacagattagcccaacaatcagcggaacttggtgccaagctattcgtgttagatgatggctggtttggcgtgaaacatcctagaatctctgacaatgcaggtttgggtgactgggaggttaatccaaaaagatttccagatggtctggaggctttagtcgataaagtaactgctttaccagtaggcaattctagtaccaaattgagatttggtttatggtttgaaccagaaatggtgaatcctgattcatctttgtatgaggaacatccagattgggccctacatgcaggaaaatatcctagatcattgactaggaaccaattagtactcaacgttgccttacctaaagttcaagacttcatagttgacgctgtctcaaatatcttaaagtcatcaaatattgcttacgttaagtgggataacaatagaggtatccatgaaaccccaacaccacacacagatcaccaatacatgttgggtttgtacaaggtgttcgccaggttgaccgagcgtttcccagacgttatatgggagggctgtgcatcaggaggtggtagatttgatcctggtgtcttacagtactttccacagatatggacatcagatgatacggatgcggttgagagaatatacatccaatttggcacctcacttgtatatccaccaagcgctatgggagcccatgtttctgcaacacctaattctcaatctggcagaaacgaaacaatcgagttcagagcacatgtggctatgatgggcggttccttcggtttggaattggacccttctcacatgcctgaacaagacaaagccaaagttccagaccttatcaaattggctgagaaagtcaaccctattgttgtcaagggtgacatgtggagattgaggctgccagaagagtcagactacccagcagcactattcatttcagaagatggagaacaggccgttctcttttactttcagctaaaaccaactattaacaattactggcctgtagttagattacaaggcctagatgctaaagcgatgtataaggttgatggtgtgcaaacggtttccggagcaactctaatgaatagaggagtatcttacaactttgaagccggttactcttctaaggtggtgtttttcgagaagcaagatgatgatgacaaaggtggttctcctccttctcatcatcaccaccaccactaa

SEQ ID NO: 104 - DNA, 2295 bp, Aspergillus niger
atgatcgggtcttctcatgccgtggtggccctgggcctttttacgttatacggtcattctgcagcagccccagcaattggcgcatcaaacagccagactatagttaccaatggtacatcatttgcattgaatggtgacaatgtttcataccgattccacgttaatagttctaccggggatttgatatctgaccatttcggaggagttgtaagtggcactattccatctcctgtagagccagcagttaatggttgggtaggaatgcctgggagaattagaagagaatttccagaccaaggtagaggggacttcagaataccagctgtcagaatcagagaatcagcgggatacacggtttccgacttacaatacgtttcccatgaagtcatcgaaggcaaatacgctctacctggtttgccagcgacgttcggtgatgctcaggacgctactacattggtagtccacctgtacgataattactcctctgtcgctgcagatttgtcctattcaatatttcctaagtacgatgctattgtgagaagtgtcaatgtaacaaatcaaggtccaggtaacattacaatcgaagctctagcctcaatatcaatcgattttccttacgaagatttggacatggtcagcctaagaggtgattgggctagagaagctaatgttcaaagatcaaaagtgcaatacggagtgcaaggttttggaagttctactgggtattcatctcatctgcataacccatttctcgccattgttgatcctgcgacaacagaatctcaaggtgaagcctgggggtttaacttagtatacaccgggagtttttcagcacaagttgaaaagggctcacaaggttttacaagagctttactaggtttcaatccagatcagttaagttggaacttaggtccaggagaaactttaacatcccctgaatgcgtcgcagtttacagcgataaaggcctaggctcagtctctagaaaatttcatagactctacagaaatcatctaatgaaaagtaagtttgcaacttctgatcgtccagtattactgaatagttgggaaggtgtttactttgattacaatcaatcaagcatcgagacactagctgaggaaagcgctgctttgggcgtccatctgtttgtaatggacgatggctggttcggagacaagtatccacgtgtaagtgacaatgctggattgggagattggatgccaaaccctgccagattccctgatggtctaacaccagtggttcaagacatcacaaacttgacggttaatggcaccgagtctacaaaactcaggttcggaatctgggttgaaccagaaatggtgaatccaaactctactttgtatcatgaacacccagagtgggccctgcacgctggtccatacccacgtaccgagaggagaaatcaattggttttaaacttggcattaccagcagtgcaggattttatcatcgatttcatgacaaatctacttcaagacactggcatttcctatgttaagtgggataataacaggggaatacatgagactccatctccatccactgaccatcaatacatgttgggcctgtacagagtttttgatacattaacaacaagattcccagacgttttgtgggaagggtgtgcatcaggaggtggtagattcgatgctggaatgcttcaatatgtcccacaaatctggacttctgataatactgacgctattgatcgtattacaattcaattcggtacttccttagcgtatcctccatcagcaatgggtgctcacttgtctgcagttcctaacgctcaaacaggcagaactgttccttttaccttcagagcccatgtggccatgatgggaggttcatttggattagaacttgacccagcaacagtcgagggtgatgaaattgttcctgagttgttggctttggcagaaaaagtcaacccaatcatccttaacggtgatttgtacagactcagattacctcaggattctcagtggccagctgcactttttgtttctcaggatggtgcccaagctgttctcttttacttccaagtacaaccaaacgtgaaccatgccgtgccttgggtaagacttcaaggcttagatcctaaggctgactatactgtagatggtgatcaaacttattctggcgccactcttatgaatttgggtttacaatactcctttgataccgagtacggctcaaaagtcgtgttcctcgaaagacaagatgatgatgacaaaggtggttctcctccttctcatcatcaccaccaccactaa

SEQ ID NO: 105 - DNA, 2313 bp, Pyrenophora teres f. teres 0-1
atggttggcatgaaggctgtttacacgttgagcctgctggccggcgtcgctgttggacaaaacgggaaatcaattaaagcagctggtacaaatttcactttgacagctgatggaatgtcttatttgtttcatgtggatacagctacaggtgatctaatatctgatcattttggtggtccaacaactgacttcaccccaccagcgaagataaacccttctggatgggtggacaaattaggaaatactagaagagaatttccagatatcggaagaggtgattttagattgccagcgattcatattcaacatgcagatggagatacagtcactgcctttcgttaccaatcccatgaaattatcaacggaaagcctggcctaccaaaactaccagccacttacggagaagcaggcgacgttacaaccgttatagtacacatgtacgataatatctcagatgtctctgcagctttgtcttactctatttttcctagatataatgctatcgctagaagtttcagcatatctaataatggatcatccgatattgttatcgaaagagcatctagcttttcaactgatttgccaaatgttgagctagatatgatcgaaccatacggtgattggtctagggagtttcagactgtaaaaaggaaaatcgattacggtgaaacaactttcagatcaacagctggttacgcttcacatatccataacccatttttcacattggtttcaccaactactaccgagtctacaggggaagcctggggcttcagtctcgtgtggacaggttcctttacagcaacggctcaaagattcgctaacggttacgtcagagtgttaatgggtcttaattcacttcatgcctccattagagtagctccaggagctacgtttcagtccccagaagctgtgggtgtctactcctctaacgggataggcggaatgtcaagatcattccacgacttgtacagaaatcacttatcaagatccaagtttacttcccaaactcgaccaatcttactcaattcatgggaaggacttggtttcaagatcaatgaaactgccttagtgaatcttgctggtgaggcagaggaaattggaatcgaattgtttgttatggatgacggctggtttggtgtagaatatccaaggaacaacgacactatgggcttgggggattggactccaaatccagccaaatttccatcagggcttagaccatacgtggaaaaagtgaataagtttaacgttttgaactctacaacaccattacaatttggtatatgggtcgaacctgagatggtaaaccaaaactctactttatacaaggaacatcctgattgggttttacatgctggtaagcatgagagaacagttactcgtacacaacttgttttgaacgttggcttaccagaagtacaagacttcatcattgattctgtttcaagagtccttgattctgccaatatacaatatgtcaaatgggacaataatagaggtatccatgaactcgcaagaccttctgatgactacacctacatcctgggattatacagagtcattgacacacttacaacaaaatatcctaatgtgctattcgaaggttgtgcttcaggagggggaagatttgatcctggccttctccactactggagccaacattggacctctgacaatacagatgcctctaatcgactgaccatccaaatgggcacttccctggtatacccaccatctgcaatgggctgtcacatctctgctgttcctaaccatttgaccaaaagatccatttctattgaatatagaggtcatgtagcgatgatgtgtggatcattcggtctggaattaaacccatccgaactctccgctgaggagactgcactactgccaagtctaatggccgaagctaaagcaattaatcctattgttatatcaggtcacttctataggttagctcatcctgatgtatctaactggcctggggtacagttcgttagtgccgatgggacacaggcggttgtttttgcgtttcaacaattgtacatggtcaagccagccgcaccacctctaaaactacaaggtttggacccaaaagcacgttacagtaatgaccttgacaacggtacttatagtggagccacctacatgaacggcggtttgaatattccttggccacagggtgattatcaatcaaagataatctggttgaatagagtcactgcaaatggtagtcaagcaagagaagcacctatctgcgatgatgatgacaaaggtggttctcctccttctcatcatcaccaccaccactaa

SEQ ID NO: 106 - DNA, 1410 bp, Talaromyces emersonii
atgcttcatcgtgctactaccactgctgccgcggcggcagcagcagcgttattactttgcccagtccaggccttagttagaccagatggtgtgggaaagctaccagcattgggctggaactcctggaacgccttcggttgtgacatcgatgaagagaaaattctaacagctgcaaatcaaatcgtgaacttgggcctgaaagaccttggatatgaatacgtgaatattgatgattgttggtctgtgaaaagtggtagaaatgctacaacaggaaggattatgccagatttgacaaaatttcctgatggaatcagtggtttagctgaaaagatccataatctaggattgaaaatcgggatatacagctcagccggttggactacctgcgctggttacccagcttctctggggaatgagacaatagacgccgaaacattcgctgaatggggtattgattacttaaagtacgataattgtggtgttcctcctgattggcaggatcaatactcatattgcgtcccagactctggtgatccagctacaaacccaaatggcacttgtcctaatttgcaaaacccagctcctgccgtatatgactggagaacaagtaaaacggccgaaagatacagacgaatgagagatgcattgctaggcgttcaagataagagaaccattctattttccttatgtgattggggtcaagctgatgtcaacgaatggggtgcagagacaggtaattcatggagaatgtctggagatatatcaccaaattggccacgtatctccacaattgcaaaccttaattccttcgaacttaattccgttgacttttggggacataacgatcctgacatgttggaagtagggaatggtaatctcactctcgcagaaaatagggcccatttcgctttgtgggcagctatgaaatcaccactcatcatcggcacagcgttggacaagatcgatcaggatcatctgtctattttgagtaataagtacttgttgacctttcaccaagacccacaaataggcagaccagcatatccttacaagtggggttacaatccagactggacatttgatcctggccatccagctgaatactggtctgggccaactagctctggcgacgttctggtactcatgttaaacactgagtctggacctgctaacagaactgccgtctggtctgaagtaccagagctaaaaggtagaaacaacaacaataattcatcatctactggatttcaagtaacggacgcatggactggatcatcacttggctgtgttcaaggtggttatagcgttgagttagaatctcatgatgttgctgtcttagttgtgtcaggggaatgcgatgatgatgacaaaggtggttctcctccttctcatcatcaccaccaccactaa

SEQ ID NO: 107 - DNA, 1689 bp, Aspergillus niger
atgatacagggacttgagagcatcatgaatcaaggaaccaagcgtatactactggctgccacgctagcagccaccccctggcaagtctacggctcaattgaacaacctagtctgttaccaacacctccaatgggctttaacaattgggcaagattcatgtgcgacttaaacgagacattgttcacagaaaccgctgatactatggctgccaatggcttgagagatgctggttacaatagaattaaccttgatgattgctggatggcgtaccaaagatcagacaatggtagtctccaatggaatactacaaaattcccacatggtttgccttggttggcaaaatatgttaaagctaagggtttccatttcggcatctacgaagattccggaaatatgacttgtggtggttacccaggaagttataatcatgaggaacaagacgctaatacattcgcctcctggggtattgactacttgaaactagacggttgtaatgtttacgcaacgcagggccgtacgctcgaagaggaatacaaacagcgatatgggcattggcatcaggtactttcaaaaatgcaacatccattgatattttctgaatctgctccagcatatttcgcaggcacagataacaatactgactggtatacagtaatggactgggtaccaatctacggagaactggccagacactccactgacattctggtgtacagtggagctggatcagcttgggattccatcatgaacaactacaattacaatacattgttagctagatatcaaagaccaggatactttaatgatccagattttctgatccctgatcaccctgggcttactgccgacgaaaagagatcacattttgctttatgggcttccttttcagcaccattgatcatctctgcctacattcctgctttgtctaaagatgaaatcgcatttctgactaacgaagcattaattgcggtgaatcaagatcctctagcgcaacaagcaactttggcaagcagggatgataccctagacatattaaccagatcattagctaacggtgacagattattgacagtcctcaacaagggcaatactacagttactagagatattccagttcaatggctaggtttaacagaaacagattgcacttacacagctgaggatctctgggacggtaaaacccaaaagatttctgatcatatcaagatagaattggcctctcatgctactgcggtctttagattaagtctaccacaaggctgttcctctgtagtccctactggtttggtgtttaatactgcatctggcaactgtcttacagccgcaagcaactcctcagtcgcctttcaatcatgtaacggtgagacatctcaaatctggcaggttactccaagtggtgttattagaccagtgtctcaaacaacacagtgtttggctgctgatggtaatcttgtaaaacttcaggcatgtgattcaacagattctgacggacaaaaatggacgtacccagttactggtaatttgaaaaacgccaagacagatggttgccttaccgaaggctctgttcaaatgaagtcttgtttgtatgaaagggatgggcaagtgtttgggctaccatcaggggttcaattagctgatgatgatgacaaaggtggttctcctccttctcatcatcaccaccaccactaa

SEQ ID NO: 108 - protein, 462 aa, Trichoderma reesei
MTPHSIDRAARPSVWSGLALLLSTAHAIVMPDGVTGKVPSLGWNSWNAYHCDIDESKFLSAAEVIVSSGLLDAGYNYVNIDDCWSMKDGRVDGHIAVNTTRFPDGIDGLAKKVHDLGLKLGIYSTAGTATCAGYPASLGYEDVDAADFADWGVDYLKYDNCNVPSDWQDEYVACAPDAVQTGPNGTCSTALEPNLAPPGYDWSTSKSAERFNAMRNALAKQSREIVLSLCIWGVADVFSWGNETGISWRMSGDISPEWGSVTHIINMNSFKMNSVGFWGHNDADILEVGNGNLTAAETRTHFALWAAMKSPLLIGTDLAQLSQENIELLKNKHLLAFNQDSVYGQPATPYKWGVNPDWTFNYTNPAEYWAGPSSKGHLVLMMNTLDHTVRKEAKWSEIPGLSAGRYEVRDVWTDKSLGCLSSYKTAVAAHDTAVILVGKKCRNWDDDDDKGGSPPSHHHHHH

SEQ ID NO: 109 - protein, 444 aa, Trichoderma reesei
MTPHSIDRAARPSVWSGLALLLSTAHAIVMPDGVTGKVPSLGWNSWNAYHCDIDESKFLSAAEVIVSSGLLDAGYNYVNIDDCWSMKDGRVDGHIAVNTTRFPDGIDGLAKKVHDLGLKLGIYSTAGTATCAGYPASLGYEDVDAADFADWGVDYLKYDNCNVPSDWQDEYVACAPDAVQTGPNGTCSTALEPNLAPPGYDWSTSKSAERFNAMRNALAKQSREIVLSLCIWGVADVFSWGNETGISWRMSGDISPEWGSVTHIINMNSFKMNSVGFWGHNDADILEVGNGNLTAAETRTHFALWAAMKSPLLIGTDLAQLSQENIELLKNKHLLAFNQDSVYGQPATPYKWGVNPDWTFNYTNPAEYWAGPSSKGHLVLMMNTLDHTVRKEAKWSEIPGLSAGRYEVRDVWTDKSLGCLSSYKTAVAAHDTAVILVGKKCRNW

SEQ ID NO: 110 - protein, 316 aa, Streptomyces avermitilis
MPERQSEPTPDESAPRPWSPFASSPASEPSHPGHLPLPTEEPPTPWQPGGTPDTSRVPGTRRLWLAGALALATVVACVTALTTTDHAADTSAAKEADTKLDSADPGLLTFASPSAGPSTYPGAKSGRSSERAAQTTPDGSASADPARHGSASKPAAERSKPASSTGTSSGSKPSAVWKSVRSVNYPDRYWHLGGDTGRLDPVSSGSSATTRQDATFKLVKGLADASCYSFATADGTYLRHSRFRLRADRNDGTALFKKDATFCPRTSSYSGAVMLESVNYPGRYLRHKDFLLRLDPYENTGQYRADSAFQLVKGWD

SEQ ID NO: 111 - protein, 536 aa, Streptomyces avermitilis
MTVPPSFLRPLSAAFAMLLLLVLAPALLVLRAAPPAQALDNGLARTPPMGWNDWNAFGCNVTEQLVKQTADYLVSSGLKGAGYQYVNIDDCWMTSARNSVGQLVPDPVKFPDGISGTAAYVHSKGLKLGIYESAGTATCQGYPGSLGHEQTDADSFASWGVDYLKYDNCNHQNVPDQQRYTAMRDALVNTGRPIVYSLCNWGLASVWTWGAGVGNSWRTTDDINVNFSTVVSIYKANVKLAPYAKPGAWNDPDMLEVGNGMSFTEDRSHFSLWSEMAAPLIAGTDLRKASAATLFLYGNKDVIAVDQDSLGKQGTEVSSSGGLHVLTKPLANGDVSVVLFNENSSAATITTSATAAGLPAASSYRLDNLWSHVVSSTGGSISASVPGHGSVMYRVSVGSGTSAGSTHPLVGASSNRCLDAYDNQTAPGTKIEIWDCGGANQAVTITAAGELRLYGGTQCLDAYDNGTTSGTKVQLYTCNGGANQKWSLNPNGTVTGTQSGLCLDVTGGDQASGNVNGTALELWTCNGGANQQWRLG

SEQ ID NO: 112 - protein, 608 aa, Streptomyces avermitilis
MGSSSYAVIPGAAPRSGRRSIRAVLVLALTAGVATVVPAAQADTSTPAAAPVAAKPYMGWSSWSMQSSKYPGLNPDGDYSYLTEANVLKQTDALASKLKKYGYDHVNIDAGWWMDKNWKTQFDQYGRQTPDPVRFPHGMKSVADHIHSKGLKAGIYLPVGLEKGAYGDGKTPISKAPGCTTADIVYSDLRTTNGWDNAYKIDFDKSCAQKYIDSQAQMFADWGYDFLKLDGVGPGSFKSGDNYNNVADVAAWQKAIAATGRPIHLELSWSLDIGHAADWKKYSNGWRIDTDIECYCNTLVTWENSVNDRWDDAPAWSSKAGPGGWNDLDAIDVGNGEMDGLTKAERQSYMTLWAINKSPLFTGDDLTKLDSYGVSLLTNKEVIAVDQNTSPVARPVTPVGDQQVWGTKNADGSYTVALFNLGDSPASVTAHWASFGFTGNASVRDLWNKTNLGTHKNKITEALPAHGSRLFTIKPGGGTLATTGYEAEAAANTLSGNASVGGCDACSGGKKVGNLYTGGKLRINDITVKKDGIYTVKVAYVSGDPRSVTVLSNSGNGTSLKFPSTGDWSTAETVSVQLALKAGSNTITFDSGSGYAPDIDRIVVPQSV

SEQ ID NO: 113 - protein, 682 aa, Streptomyces avermitilis
MRHPYARTTRTTRTTRTTRRRVVGALTAGLLCTAGLAAPALAAPAAGPVSPRPADSLALTPPMGFNNWNSTGCRPEFNEDMVKGTADIFVEKGLKDAGYQYVNLDDCWALPARDSNGKLVPDPARFPGGIKAVADYVHSKGLKLGIYTSAGTKTCNEAGFPGALGHEYSDAQQFADWGVDYLKYDNCNNQGVDAKLRYTTMRDALKATGRPIVYSLCEWGENKPWEWASDVGQLWRTTGDISDSWGSMLSILKQNLPLAPYAGPGHWNDPDMLEVGNSGMTDTEYRTHFSMWSIMAAPLLIGSDLRKASAATFDILDNKEVIAVDQDPLGKQGTVLSSEGGRWAVTKEMKDGSRAVALFNETDSAQRITTTAQAVGLPKAHAYTLRDLWQHRSYNTAGTISATVPAHGTVLVRVSADAAWAKNPPAVELGVDGSPLLEAGRTVALTSALTDLGRTPAKRVSVTLSGPRGWRVRATSPTTAGTVPTGRSLRTKWKVTAPDGTAAGSYDLTLKATYRSPTGVRAETLVPLAASVVPAPPSGVSYLGDLPWMSTTNGWGPVERNTSNGESAAGDGRPITVDGVVHAKGIGVHAESTIAYYTGRSCETVTADVGVDDEQDTNGSVTFEIWADGTRVASTGVLTTAMPARPLSADVTGAQVVRLVVTDGGNGITSDHADWADAKLSC

SEQ ID NO: 114 - protein, 818 aa, Clostridium phytofermentans
MISFENDVFWLDTDTTSYVFRITPYGHPEHIYYGRKLAHQPVDALALKRTATIGSSVLYEPNDPLYCLDHLSLEWSGIGRGDYRFSPAEIKMPDGSFTNDFIYDSYRIMDGCTPMEELPFAKSEDAQTLEIVLVDNVGHATLSLYYTVFSQTDVITRRCTLRNQGPNFQNKSHSLQQNDEQISTLQDSQSHLEVKNSCENEQHKESPIVIRRLMSMMVDLPNQSYQLITFDGDWIKEAHRHDRLLMPGMYVNGSVTGTSSNRHNPGFLLANERADETHGNVYGFNLIYSGNHFGGAELSPHGLVRVTLGINPHCFEWVLNPGESFSTPQAVMTFSDQGFHGMSRHFHDFINQHIVPEYWQNRERPILYNSWEAYFFKFNQRKLLHTAKHARSLGMELFVLDDGWFGKRNNDNAGLGDYEVNKKKFPHGISAFSRKIRKMGMEFGLWFEPEMVNEDSDLYRKHPDWAVHTPRRNPTYGRNQLVLDLCNPKVRDYIVESVGTVLDDAEVSYVKWDMNRHISDAYSRLLSEQGEFFHRYILGLYEILKRIFAPRPHILLETCSSGGNRFDLGMLCFGPQIWVSDCTDPVERLSIQGGLSFLYPPSTFGAHVSEAPHQQTLRQTPLATRFHTACFGCLGYELELKYLSKIERSEIREQIAFYKLHRPTLQFGKFRRLEPIKSNIIQWQCTEKDESKAIAGYFQTLANANPEHDILIVSDLNEKYNYQVTTKRQRLFIKRFGGLIKHVLPVSLNPDGFLLRLVNRFYALLDCTEEYIGDGRLLGSGILLNNQFMGSYYNFETRLLGDFGSNLYLIKQMESEVS

SEQ ID NO: 115 - protein, 460 aa, Aspergillus niger
MRWLLTSSALLVPAAALVRPDGVGLTPALGWNSWNAYSCDIDADKIVTAANEVVNLGLKDLGYEYINIDDCWSVKSGRNTTTKRIIPDPDKFPNGISGVADQVHALGLKLGIYSSAGLTTCAGYPASLGYEEIDAQSFAEWGIDYLKYDNCGVPTNLTDQYTYCVPDSTDGSNYPNGTCVNLTDAAPQGYDWATSTTAKRYQRMRDALLSVNRTILYSLCDWGQADVNAWGNATGNSWRMSGDITATWSRIAEIANENSFLMNYANFWGYPDPDMLEVGNGNLTLPENRAHFALWAMMKAPLIIGTPLDSIDTSHLTILSNKPLLTFHQDAVIGRPAYPYKWGYNPDWTFDPEHPAEYWSGPTSSGEVFVLMLNSEGEVKTRSAVWEEVPELKDRGTKKNSKEKKGFKVTDAWTGKDLGCVKDKYEVKLQAHDVAVLVVGGQCDDDDKGGSPPSHHHHHH

SEQ ID NO: 116 - protein, 642 aa, Talaromyces stipitatus GH31
MNYIIDDLDKMARLFATAIAITGALAQTNCTGSSYVPGSVNFTLECYNAIQNCVSKFEANASLVDCNDGQGNIYMQQQASLTSTSPNSDIVIAFQDILELCILSGSTSGTWGYSDNQWYWTAAEPACYVDSTTDVVPTRPAPFCIQDRDSSLPDCYPQPKSIASSANKFKVLKTSGSTPNGFNSSARGWNTYGIQALSNGSEVVPSFVGSSGLNYLQEFVKTQCGVLAQSGFQQAGYVYCSLDSGWQTQTTDEYGRIVYDSTRFNLPQLASWLHGQGLKLGVYVVPGVPCSAANKTIKGTNISINDALNGNNDQLYCSWNFSKDGVQEWHDSVVAQWASWGVDMIKLDFLTPGSPQNGANLDCDSSDAAHAYLNAIKASGRHMRLDLSWKLCRNETWLPIWSQLGDSMRIDQDLDNYGYNTFVAWATAQRAIDNYRQYIGLQAQRNVPLTTYPDMDNLFTANAENLTGVPDLQRITIMNHWLGAGANLILGGDLTAIDSLGYQLLTSAESIAAADFFSQYPMQPRNPSTGDNLAQQLQAWIAGPSDDSIAYVLLVNYGPDQGQGGFGTQLKGIQDVTVSLEDLGISGSSWHATDLWNGTATKITDSYTVALDEGASQLLRLTTASDDDDKGGSPPSHHHHHH

SEQ ID NO: 117 - protein, 408 aa, Aspergillus niger
MMKRKSQLSSFTLVTAAILPFAHFVMGGTSLAQKPQMGWNSWNAFKATVNYTIVQEVISLFDTLGLKEAGYEYVLLDDGWASYNRTSDGYLQANATSFPQGIKALAQEVHGKGLKLGLYGDSGHYTCAWRPGSWGYEERDAQTFAGWGVDYLKYDNCGGFQSMTEAPQIRFGAMKNALTLSGRDIFYSVCGWGYQFPWHWGGDIGHSYRMSGDITTSFTNETECQCKTAYCLNTGQYQTPGHWLDMDMLEVGNANFTLNQQQTHFAFWAALKSPLIIGADLSKLSNDSLAVLTNKAIISINQDALGEPVTYREAHSKEGLFQVWAGKVEDGYVVLLLNEKSYPQTVSLSFASLGLGSPQKVTELWSGQTLQDLSMISANPQSRQIDILNIKDDDDKGGSPPSHHHHHH

SEQ ID NO: 118 - protein, 764 aa, Metarhizium acridum CQMa 102
MGQVPALCRLTVLLLVAGMASAASAQGGSQKPIEVDGTTFALNGDNVSYRFHVDTTTGDLIGDHFGGPVESDTIEAEIGPVQGWVDMIGRVRRELPDLGRGDFRTPVVQIRQSEGYTVSDFQYQGHTVLEGKPALNGLPSTFGKDEDVSTLVVHLYDNYSSVAADLGYSIFPKYDAIVRSVNITNSGEGNITIEKLASFSVDLPWGDYDMLELKGDWAREGMRIRRKIDFGIQGFGSTTGYSSHLYNPFLSVVSGATTESHGEAYGFSLVYTGSFSAEVEKSSQGLTRAMLGFNPSQLAWPLGPGESLQSPECVAIFSSTGIGGMSRKLHSLYRQHLMKSKYATETRPVLLNSWEGLGFNYNASTIYRLAQQSAELGAKLFVLDDGWFGVKHPRISDNAGLGDWEVNPKRFPDGLEALVDKVTALPVGNSSTKLRFGLWFEPEMVNPDSSLYEEHPDWALHAGKYPRSLTRNQLVLNVALPKVQDFIVDAVSNILKSSNIAYVKWDNNRGIHETPTPHTDHQYMLGLYKVFARLTERFPDVIWEGCASGGGRFDPGVLQYFPQIWTSDDTDAVERIYIQFGTSLVYPPSAMGAHVSATPNSQSGRNETIEFRAHVAMMGGSFGLELDPSHMPEQDKAKVPDLIKLAEKVNPIVVKGDMWRLRLPEESDYPAALFISEDGEQAVLFYFQLKPTINNYWPVVRLQGLDAKAMYKVDGVQTVSGATLMNRGVSYNFEAGYSSKVVFFEKQDDDDKGGSPPSHHHHHH

SEQ ID NO: 119 - protein, 764 aa, Aspergillus niger
MIGSSHAVVALGLFTLYGHSAAAPAIGASNSQTIVTNGTSFALNGDNVSYRFHVNSSTGDLISDHFGGVVSGTIPSPVEPAVNGWVGMPGRIRREFPDQGRGDFRIPAVRIRESAGYTVSDLQYVSHEVIEGKYALPGLPATFGDAQDATTLVVHLYDNYSSVAADLSYSIFPKYDAIVRSVNVTNQGPGNITIEALASISIDFPYEDLDMVSLRGDWAREANVQRSKVQYGVQGFGSSTGYSSHLHNPFLAIVDPATTESQGEAWGFNLVYTGSFSAQVEKGSQGFTRALLGFNPDQLSWNLGPGETLTSPECVAVYSDKGLGSVSRKFHRLYRNHLMKSKFATSDRPVLLNSWEGVYFDYNQSSIETLAEESAALGVHLFVMDDGWFGDKYPRVSDNAGLGDWMPNPARFPDGLTPVVQDITNLTVNGTESTKLRFGIWVEPEMVNPNSTLYHEHPEWALHAGPYPRTERRNQLVLNLALPAVQDFIIDFMTNLLQDTGISYVKWDNNRGIHETPSPSTDHQYMLGLYRVFDTLTTRFPDVLWEGCASGGGRFDAGMLQYVPQIWTSDNTDAIDRITIQFGTSLAYPPSAMGAHLSAVPNAQTGRTVPFTFRAHVAMMGGSFGLELDPATVEGDEIVPELLALAEKVNPIILNGDLYRLRLPQDSQWPAALFVSQDGAQAVLFYFQVQPNVNHAVPWVRLQGLDPKADYTVDGDQTYSGATLMNLGLQYSFDTEYGSKVVFLERQDDDDKGGSPPSHHHHHH

SEQ ID NO: 120 - protein, 770 aa, Pyrenophora teres f. teres 0-1
MVGMKAVYTLSLLAGVAVGQNGKSIKAAGTNFTLTADGMSYLFHVDTATGDLISDHFGGPTTDFTPPAKINPSGWVDKLGNTRREFPDIGRGDFRLPAIHIQHADGDTVTAFRYQSHEIINGKPGLPKLPATYGEAGDVTTVIVHMYDNISDVSAALSYSIFPRYNAIARSFSISNNGSSDIVIERASSFSTDLPNVELDMIEPYGDWSREFQTVKRKIDYGETTFRSTAGYASHIHNPFFTLVSPTTTESTGEAWGFSLVWTGSFTATAQRFANGYVRVLMGLNSLHASIRVAPGATFQSPEAVGVYSSNGIGGMSRSFHDLYRNHLSRSKFTSQTRPILLNSWEGLGFKINETALVNLAGEAEEIGIELFVMDDGWFGVEYPRNNDTMGLGDWTPNPAKFPSGLRPYVEKVNKFNVLNSTTPLQFGIWVEPEMVNQNSTLYKEHPDWVLHAGKHERTVTRTQLVLNVGLPEVQDFIIDSVSRVLDSANIQYVKWDNNRGIHELARPSDDYTYILGLYRVIDTLTTKYPNVLFEGCASGGGRFDPGLLHYWSQHWTSDNTDASNRLTIQMGTSLVYPPSAMGCHISAVPNHLTKRSISIEYRGHVAMMCGSFGLELNPSELSAEETALLPSLMAEAKAINPIVISGHFYRLAHPDVSNWPGVQFVSADGTQAVVFAFQQLYMVKPAAPPLKLQGLDPKARYSNDLDNGTYSGATYMNGGLNIPWPQGDYQSKIIWLNRVTANGSQAREAPICDDDDKGGSPPSHHHHHH

SEQ ID NO: 121 - protein, 469 aa, Talaromyces emersonii
MLHRATTTAAAAAAAALLLCPVQALVRPDGVGKLPALGWNSWNAFGCDIDEEKILTAANQIVNLGLKDLGYEYVNIDDCWSVKSGRNATTGRIMPDLTKFPDGISGLAEKIHNLGLKIGIYSSAGWTTCAGYPASLGNETIDAETFAEWGIDYLKYDNCGVPPDWQDQYSYCVPDSGDPATNPNGTCPNLQNPAPAVYDWRTSKTAERYRRMRDALLGVQDKRTILFSLCDWGQADVNEWGAETGNSWRMSGDISPNWPRISTIANLNSFELNSVDFWGHNDPDMLEVGNGNLTLAENRAHFALWAAMKSPLIIGTALDKIDQDHLSILSNKYLLTFHQDPQIGRPAYPYKWGYNPDWTFDPGHPAEYWSGPTSSGDVLVLMLNTESGPANRTAVWSEVPELKGRNNNNNSSSTGFQVTDAWTGSSLGCVQGGYSVELESHDVAVLVVSGECDDDDKGGSPPSHHHHHH

SEQ ID NO: 122 - protein, 562 aa, Aspergillus niger
MIQGLESIMNQGTKRILLAATLAATPWQVYGSIEQPSLLPTPPMGFNNWARFMCDLNETLFTETADTMAANGLRDAGYNRINLDDCWMAYQRSDNGSLQWNTTKFPHGLPWLAKYVKAKGFHFGIYEDSGNMTCGGYPGSYNHEEQDANTFASWGIDYLKLDGCNVYATQGRTLEEEYKQRYGHWHQVLSKMQHPLIFSESAPAYFAGTDNNTDWYTVMDWVPIYGELARHSTDILVYSGAGSAWDSIMNNYNYNTLLARYQRPGYFNDPDFLIPDHPGLTADEKRSHFALWASFSAPLIISAYIPALSKDEIAFLTNEALIAVNQDPLAQQATLASRDDTLDILTRSLANGDRLLTVLNKGNTTVTRDIPVQWLGLTETDCTYTAEDLWDGKTQKISDHIKIELASHATAVFRLSLPQGCSSVVPTGLVFNTASGNCLTAASNSSVAFQSCNGETSQIWQVTPSGVIRPVSQTTQCLAADGNLVKLQACDSTDSDGQKWTYPVTGNLKNAKTDGCLTEGSVQMKSCLYERDGQVFGLPSGVQLADDDDKGGSPPSHHHHHH

SEQ ID NO: 123 - DNA, 1173 bp, Neosartorya fischeri
atgaagttctccttcctcaccgtggccagcttcctcatagggcaagtagccctggccgctttgtcagctaaaaagttcgccagtgcatctgatctacaattcacaatagacgggaaaaccggttactttgcaggttctaattcatactggattgggtttttaactaataacgcagatgttgatctagtgtttgatcacatgaaggagtcaggcttgaagatcctgcgtgtatggggctttaatgacgtaaacacagtaccagggcaaggaacagtgtattaccaagtccatgctaatggtaagtcaacaatcaacacaggcgctgacggtttacaaagattggattacgttgtccattccgctgagaaaagaggcatcaaattgattatcaactttgttaataactgggatgattatgggggcatgaatgcttacgtgaaggcctatggcgaaactgatcataatgcattttactctaacaaaaatatacagaatgcctacaggagatatgttaaggcagtagtttctagatacaccaatagtccagcggtctttgcctgggaactagctaatgaacctagatgtaaaggttgtgacaccgaagttttatacgaatggattaagtctacttccgaatacatcaaaaagttagataaaagacacatggtctgcattggagatgaaggatttggtcttgatctgttgagcgacggttcatacccatacacttatgttgaaggttccaactttacgagaaaccttgcaataccaacaatcgattttggtacttttcatttgtacccagactcctggggtacaacacatgaatggggcaatggctgggctcaatctcatggagcagcttgcaaagcagctggtaaaccatgcctattcgaggaatatggtgttacatctaatcattgtgctttagaaactccttggcagaaaacatcacttaatacgactggagtcagtggagacttgtactggcaatacggagacactttatctactggacaatcaccaaacgatggtaacactatctactatggcacagatgagttcaaatgtattgttaaggatcatgttgcagctattaaggcgaaacagggttgggtggatgatgatgacaaaggtggttctcctccttctcatcatcaccaccaccactaa

SEQ ID NO: 124 - DNA, 1134 bp, Aspergillus aculeatus
atgaagctttctcacatgctcctcagcctcgccagcctgggggtggcgacggctcttccccggacgccgaaccacaacgcggccaccaccgccttccccagcacctcggggctgcacttcacgattgacggcaagacgggctactttgccgggaccaactcgtactggatcgggttcctgaccaacaacgacgacgtggacctcgtcatgagccagctggcggcatccgacctcaagatcctgcgggtctgggggttcaacgacgtcaacaccaagcccaccgacgggacggtgtggtaccagctgcacgcgaacggcacctcgaccatcaacacgggcgcggacgggctccagcgcctcgactacgtggtgacctcggccgagaagtacggcgtcaagctgatcatcaacttcgtcaacgagtggaccgactacggcggcatgcaggcctacgtcacggcctacggcgccgccgcccagacggacttctacaccaacaccgccatccaggccgcctacaagaactacatcaaggcggtcgtctcgcggtacagcagctccgccgccatcttcgcctgggagctggccaacgagccccgctgccagggctgcgatacctcggtcctgtacaactggatctcggacacgtccaagtatatcaagtcgctggactccaagcacctggtcacgattggcgatgagggcttcggtctcgacgtcgactccgacggcagctacccctacacctacggcgagggattgaacttcaccaagaacctgggcatctcgaccatcgacttcggtactctgcatctgtaccccgatagctggggcacctcctacgactggggcaacggctggatcacggcccacgcggccgcctgcaaggcggtgggcaagccgtgcctgctggaagagtacggagtgacctccaaccactgtgccgtcgagagcccctggcagcagacggccggcaacgcgacgggcatctccggcgatttgtactggcagtatggcaccacgttcagctggggccagtccccgaacgatgggaacaccttctactacaacaccagcgacttcacgtgcctggtgacggatcatgtggcggccatcaatgcgcagtcgaagtag

SEQ ID NO: 125 - DNA, 2799 bp, Aspergillus niger
atgagacattctattggtttggctgctgctttgttggctccaactttgccagttgctttgggtcaacatattagagatttgtcatctgaaaaatggactttatcttctagagctttgaatagaactgttccagctcaatttccatctcaagttcatttggatttgttgagagctggtgttattggtgaatatcatggtttgaacgattttaacttgagatggattgctgctgctaattggacttatacttctcaacctattaagggtttgttggataattatggttctacttggttggtttttgatggtttggatacttttgctactatttctattttgtggactgctaatagaatccatggtcaatctgtttctccagtttctggttctatgtatttgccagctttggaagcttgtcaaagaagaattttgattagaaaggtttcttttagaggtggtgttactgctgaagttaatacttgttacttgcatattgaatggccagatgatgttcaattgacttacgaatatccaaatagatggttcatgagaaaagaacaatctgattttggttgggattggggtccagcttttgctccagctggtccatggaaaccagcttatatcgttcaattggataagaaagaatctgtttacgttttgaacactgatttggatatctacagaaagaatcagattaactatttgccaccagatcaatctcaaccatgggttgttaatgcttctattgatattttgggtccattgccagctaaacctactatgtctattgaagttagagatactcattctggtactattttgacttctagaacattgaacaatgtttctgttgctggtaatgctattactggtgttactgttttggatggtttgaatccaaaattgtggtggccacaatcttcagttattagaacttctactatgttcttgtctttgtctaaagttgaaggtactagaccatggccagtttggactaatggtagagcttctgctccattttttttgaatcaaagaaacattactgaagttcaaagagcacaaggtattgctccaggtgctaattggcattttgaagttaatggtcatgaattttacgctaagggttctaatttgattccaccagattctttttggactagagttactgaagaaagaatttctagattattcgatgctgttgttgttggtaatcaaaacatgttgagagtttggtcatctggtgcttacttgcatgattacatctatgatttggctgatgagaaaggtattttgttgtggtctgaatttgaattttctgatgcattatacccatctgatgatgcttttttggaaaatgttgctgctgaaatcgtttacaacgttagaagagttaatcatcatccatctttggctttgtgggctggtggtaacgaaattgaatctttgatgttgccaagagttaaggatgctgctccatcttcttattcttattacgttggtgaatacgaaaaaatgtacatttctttgttcttgccattggtttacgaaaacactagatctatttcttattctccatcttctactactgaaggttacttgtacattgatttgtctgctccagttccaatggctgaaagatatgataacactacttctggttcttattatggtgatactgatcattatgattacgatacttcagttgcttttgattatggttcttatccagttggtagatttgctaatgagttcggttttcattctatgccatctttacaaacttggcaacaagctgttgatactgaagatctatacttcaactcttctgttgttatgttgagaaatcatcatgatccagctggtggtttgatgactgataattacgctaattctgctactggtatgggtgaaatgactatgggtgttatttcttattatcctattccatctaagtctgatcatatttctaatttctctgcttggtgtcatgctactcaattatttcaagctgatatgtacaagtctcaaattcaattttacagaagaggttctggtatgccagaaagacaattgggttcattatattggcaattggaagatatttggcaagctccatcttgggctggtattgaatatggtggtagatggaaagttttacatcatgttatgagagatatctaccaaccagttatcgtttctccattttggaattatacaactggttctttggatgtttatgttacttctgatttgtggtcaccagctgctggtactgttgatttgacttggttggatttgtctggtagaccaattgcaggtaatgctggtactccaaaatctgttccttttactgttggtggtttgaactctactagaatctacggtacaaacgtttcttctttgggtttgcctgatacaaaagatgctgttttgattttgtctttatctgctcatggtagattgccaaattctgatagaactacaaacttgactcacgaaaattatgctactttgtcttggccaaaagatttgaaaatcgttgatccaggtttgaaattgggttactcttctaaaaaaactactgttactgttgaagctacttctggtgtttcattatacacatggttggattatccagaaggtgttgttggttactttgaagaaaatgcttttgttttggctccaggtgaaaaaaaagaaattggtttcacagttttggatgatacaactaatggtgcttgggttagaaatattactgttcaatctttgtgggatcaaaaagttagaggttaatga

SEQ ID NO: 126 - DNA, 2794 bp, Aspergillus aculeatus
atgagagctttgccaactactgctactactttgttgggtgttttgttttttccatctgcttctagatctcaatatatggactttatcttctgctactttgaatagaactgttccagctcaatttccatctcaagttcatatggatttgttgagagaaggtattattgatgaaccatacaacgatttgaatgattttaacttgagatggattgctgatgctaattggacttatacttctggtaaaattgaaggtttgggtgaagattatgaatctacttggttggtttttgatggtttggatacttttgcttctatttctttctgtggtcaatttgttggtgctactgataatcaattcagacagtacatgttcgatgtttcttctattttgaaagcttgtccagaagaacctactttgggtattcaatttggttctgctccaaatatcgttgatgctattgctcaagatccatcttctccaacttggccagaaggtgttcaaattacttacgaatacccaaatagatggttcatgagaaaagaacaatctgattttggttgggattggggtccagcttttgctccagctggtccatggaaaccaggttatgttgttcaattgaaacaagctgctccagtttatgttagaaacactgatttggatatctatagattgggtcaaatcaattatttgccaccagatcaaactcaaccatgggttgttaatgcttcattggattatttgggttctttgccagaaaatccatctatggctattgaagttaaggacttgcaatctggtgaaattttggcttctagaccattgactaacattactgttactgaaggttctgttactggtgttactgttttggaaggtgttgatccaaaattgtggtggccacaaggtttaggtgatcaaaacttgtacaacgttactatttctgttactgatggtggtaatcaatctgttgctgaagttacaaaaagaactggtttcagaactattttcttgaatcaaagaaacattactgatgctcaattggctcaaggtattgctccaggtgctaattggcattttgaagttaacggtcatgaattttatgctaagggttctaatttgattccaccagactgtttttggactagagttactgaagatacaatgactagattattcgatgctgttgttgctggtaatcaaaacatgttgagagtttggtcatctggtgcttacttgcatgattacatctatgatttggctgacgaaaaaggtattttgttgtgttctgaatttcaattttctgatgcattatacccaactgatgatgcttttttggaaaatgttgctgctgaagttgtttacaatgttagaagagttaatcatcatccatctttggctttgtgggctggtggtaacgaaattgaatctttgatgttgttgttggttgaagctgctgatccagaatcttatccattttacgttggtgaatacgaaaaaatgtacatttctttgttcttgccattggtttacgaaaacactagatctatttcttattctccatcttctactactgaaggttacttggatattgatttgtctgctccagttccaatggctgaaagatattctaacactacagaaggtgaatattacggagatactgatcattataactacgatgcttctattgcttttgattatggtacttatccagttggtagatttgctaatgaatttggttttcattctatgccatctttacaaacttggcaacaagctttgactgatccagctgatttgacttttaactcttctgttgttatgttgagaaatcatcattatccagctggtggtttgatgactgataattaccataatactgttgctagacatggtagaaatgatccaggtagagctggtttgttgccagatgctcaacattctgttagaccaagaggtcaattgcaaagattggttccaagagatccagctttgccaggtggtccattgcaagttactaatccagttttaccagctggtcaaagagctgctagaactccagctagagttccagttttggctgctagaggtcatttggctggtgctttggttggtggtgatagagttaggagaccattggaaggtccacattatgttgctagagatatctacaagccagttatcgtttctccattttggaattatacaacaggtgcattggatatctacgttacttctgatttgtggactgctgctgctggttctgttacattgacttggagagatttgtctggtaaacctattgcttctaatggtggtttgccaacaaaaccattgccatttcatgttggtgctttgaactctactagattatacagaatgaacatgaagcaacaaccattgccaagacatgaagatgctattttggctttggaattgactgctactggttctttaccaaatactgatgaagaagttactttcactcacgaacaatggtttactccagcttttccaaaagatttggatttggttaacttgagagttagagttgaatatgatgctccattgggtaaatttgctgttgaagctactgctggtgttgcattatacacttggttggaacatcctgaaggtgttgttggttactttgaagaaaactcttttgttgttgttccaggtcaaaaaaaagttgttggtttcgttgttcaagctgacgaaactgatggtgaatgggttcatgatgttactgttagatctttgtgggatttgaatgaaggtgagtaatga

SEQ ID NO: 127 - DNA, 2796 bp, Neosartorya fischeri
atgcacgttaaggctgaaactgttttggctttgttgactccaggtttgccatctgttgttggtcaacatgttgttgatttgtctggtgatggttggactttatcttctactgctttggatagaactgttccaggtcatttgccatctcaagttcatttggatttgtttgaagctggtgttattaacattaccgcttctatgattttgactttcgttggtttgttgatgccaattggtagaataccagctactagattgaaagcttgtgatttggaaaatttcgaatctacttggttggtttttgatggtttggatactttcactaccattactttctgtgatcaacatgttggttctactgataatcaattcagacaataccatttcgatgtttctcaaatcttgaaagaatgtaagcaagatccagttattagaatcaattttggttctgctccatctattgctaatgctattgctaaatctccagatgctgaagaatggccaccaggtgttcaaattactaatgaatacccaaacagatggtacattagaaaagaacaatctgattttggttgggattggggtccagcttttgctccagttggtccatggaaaccatcttatatcgttcaaaacaaccatgctgaattatacgttttgaacaccgatttggatttttacagacaaggtcaaatcaattatttgccaccagatcaatctcaaccatggatagttaatgcttctattgatattttgggtccagttccttggaaaccatcaatgtctattgaaatcaaagatgctgctactggttctgttttatcttctggtttgttgcaaaatgttactgtttctggtaattctattactggtactactactattgatggtgatgctccaaaattgtggtggccatctggtatgggtgaacaaaacttgtataacgttactgttactgttcaaaacgataagaaaaagtctttggctaaagttacaaagagaactggtttcagaactatcttcttgaatcaaagaaacattaccgatgatcaattggctcaaggtattgctccaggtgctaattggcattttgaaatcaatggtcatgctttttatgctaagggttccaatattattccaccagatgctttttggccaagagttactcaagctagaatggctagattatttgatgctgttactgctggtaatcaaaacatgttgagagtttgggcttctggtgcttacttgcatgattttatctatgatttggctgacgaaaaaggtattttgttgtggtctgaatttcaattttctgatgccttgtatccagttaatgatgcttttttggaaaatgttgctgctgaagttgtttacaatgttagaagagttaatcatcatccatctttggctttgtgggctggtggtaacgaaattgaatctttgatgttgccaatggttaagagagctgatccaactggttattctaaatacgttggtgaatacgaaaagttgtacatttctttgattttgcctttggtttacgaaaacactagatctattacttattctccatcttctactactgaaggttacttgtacgttaatttgtctgctccagttccaatggctgaaagatattctaacactactccaggttcttattatggtgataccgattactataactacgatacctctgtttcttttgattacaaccattatccagttggtagatttgctaatgaatttggttttcattctatgccatctttacaaacttggcaacaagctgttgatccagaggacttgcattttaactcttccgttgttatgttgagaaatcatcattatactgctggtggtttgtttactgataacttcaagaactcttctaaaggtatgggtgaaatgactatgggtgttgaagcttattatccaattccatctaagtctgattctgttgctaatttttctgcttggtgtcatgctactcaattatttcaagccgatatgtacaaatctcaaatccaattttacagaagaggttctggtatgccagaaagacaattgggttcattatattggcaattggaagatatttggcaagctccaacttgggctggtattgaatatgatggtagatggaaggttttacattatgttgctagagatatctaccaacctattatcgtttctccattttggaattatacaaccggtagattggaagtttatgttacttctgatttgtgggaaccagctcaaggtactgttaatttgacttgggttgatttgtcaggtaaaactattgctaacaatgctggtactccagaaactgttaattttactgttggtgctttgaacactactaatatctacactaccaacatttctgaattgtctttgccagatttgaaagattccattttgattttgtcattgtctggtgaaggtagattgccaaatacttcttctaaaaaggctttcgttcatcaaaatcattttactccagtttttccaaaagatttgtctttgaaggatccaaaattggaaatttcttactctccagaatctagaaagtttactgttcaagctactggtggtgtttcattatacacttggttggattatccagctggtgctgttggttattttgaagaaaacgcctttgttttgttgcctggtgttcaaaaagaagtttcttttgctgctcaagaaggtaacgttactgacgattgggttagaagagtaactgttcaatctttgtgggatcaaaaggttagagactaatga

SEQ ID NO: 128 - DNA, 2463 bp, Saccharophagus degradans 2-40
atggttgtgaatacagacattacacaatggtcgcttactaaaactaatgcgaatggcgcccaaacccccgctgatattattccccttcagcaatggcttgctgtaccagtgcctggaaccgtggcgcaagctgtgggcgatgctggcccgcaagaagaccttgagcaatttgattggtggtacaccgctcaatttccactgcccaaaacaggtaagcgcacttatttgcagtgcgacggtttggcaaccctaagcgaagtgtgggttaacgaccagcaggttttatactcgcaatcgatgtttgaaaaccacaagctcgacattaccgattacctgcaagccgacaatacactggccatagtgtttaaagcgctcgcaccacatttggccgagcgtcgtgcaagaccgcaatggaaaaccaacctagttgataaccaaaacttgcgctggtttcgcactagcttattagggcgtatgccgggctggacaccacccgtaaaagcgataggcccgtggcgagatattagtattgttagtgtggctaaatttgatttagtggagtgcactgtgtttagcgaagtggatgaggcgctaaatggcaaggtacatataaacttagaattagattttatcgatgctaaattggcagccgacccacaaatacaatttttattagacggcaaaatctaccccataaccgcaaaacctattaaaggtggcggcgcatttatagataccgaaatagctattgagcaaccgcaattatggtggccccatacccacggcgagccctacctacacgcttacaaaattaccgccattatagatggtgaagtaacaaccttaaccgaaggtaagttgggctttaagcgcgtaactgctgctaatcaaacaaatcaattggcgcttgaagtaaacaacaacaaaatattttgtcgcggcgcctgttgggctactccaaatataactagtttaaatgcatctaagcaggagtatcgccatctattaaaactattagtagatgcaggtgcaaacatggttcgcattggcggtaccatggtgtacgaacacgacgatttttatgccttgtgcgatgagctaggtatattggtttggcaagattttatgtttgccaatatggattacccctttgcagatgaagattttagtaagcttgttgcaaaagaagtgcgccaacaaattacgcgcttaaaacaaacagcctctattgcagtattttgcggcaacagtgaaatgcagcagcaagcggccatgatgggtatggagcagacacaatgggcgaacgcactgtttgatacttttataacgcaaaaattagaagagcagcagttaacgcttccttattttacttctagcccctgcgaaggtggtttgcctttccataccgacgccggtttaacgcattactatggtgtgggcgcctataaacttatgcccgaccattttactgtgcgcgaagttggttttacttccgagtgcttagggttttcgcatataccggtaacagcttctttaaagcaagcttttgaatcaccataccccgccacccatacacccagctggaaggccggcatacctagggataacagcgcgggttgggatttcgaagatattcgcaacttttatttagaaaaaatatttggcgtagttgccgatactcttcgctatagcgacccagaaacctattttaaacttgccaccattgctactgcagaaatggtaagtagcgtgtacagcatatggcgcgcgagtatatcaaattgcaatggtgcgctggcttggttttatcaagatattgttgcgggtgcaggctggggaatagttgatagttttgcgcggccaaaagcagcgtattactttttaaaacgagtatggcagccgcagcaggtattgcttataaacaacagcttgaatggctatacgctagaagtgcaaaatgaaacagcgcatacacttcaagcgcagctcaatattgtattggttggcttaagcgataatattgttgcagagcatacgcaagaaattacgctcgcagcgaatagcgttggcacacacaagctagataccgtttttggccgttttatggatgccacccatgcctataagtttggccgccaaactatttatgctgtagtagccgagctgcgaaacgaaagcggcgaacttattagtcaggcggtatcgttcccgggttgtaggcgcatcaacaccggcgccggtgaaataacgggtagcattactagcgatagcgataatgaatcagtggtaacgttaacgcccagcgtttttgttgagtacgcgtgtttagaatcaaaaaccacacaattcagtgataactacacctgcatgttgccaggtaagacgtatagctttaaagcgtgtgaacaaatcaaaagcgtacatgtatctactcttaacctacaaaaagaatttagagtgaca

SEQ ID NO: 129 - DNA, 2571 bp, Clostridium phytofermentans
atgaaaggtctagttaaaaaagtaagtacgtttatcatcgcactatcactactgtttagttttattacagtaccggtcagtgcaggcactgcgttgttcgttatcgaaagcgaaaatacgcgactatcatctgagttacaagttgtgacggcaatatatggacaaccaaagcctggatactcgggagcaggatttgtttggatgcagaactcaggtacattaactttcgatgtcactgttccagagacaggtatgtatacgatatctactcgttatatgcaagagttaagtacggatggcagactccaatacttaagcgtaaatggtatcaataaaggttcctttatgttgccatatactacagtgtggtcagattttaattttggtatttataaattgaccaaaggtagcaacacgatacaaattaaggctggttggggattcgcttattttgatacattcaccgtggattatgctaaactagatagtttaaatgtagcgccaacccttaccgatagccaggcaacatcagaaacaaaacttctaatgaaatacttaacggaggtttacggtaaacatatcatctctggccaacaagagatctatggtggtggaaataacggtaattcagaattagagtttgattggattcacaatttaacaggtaagtatccagcgattagagggtttgattttatgaactataatccattatacggttgggaagatggtacaacaaatcgtattatagattgggttaataataaaaatggtattgcaacgggatgctggcatattactgttccaaaagattttaattcctataagcttggtgattttgtggattggcaaaagacaacctataagccaacggaaacaaattttaaaactgcaaatgctgttattcctgggacaaaagaataccaatatgtaatgctgacaattgatgatttagcaaaacagctactgatattacagcaaaacaacgtacctatcattttacgcccatatcacgaggcagaaggtaatggcggagcaaatggtgaaggtgcgtggttctggtgggcttccgcaggtgcaaaagtttataaacaattatgggaaatgttatatactaggctgacacaaacatatggattacataatataatttggacgtataacagctatgtttacagtacctctcctgcttggtatcctggtgataatttggtagatatcgtcgggtatgataagtacaatacagtctataaccgctatgacggattatccggtgttccgaacgaagatgctattacgactatcttctatcaactcgttgatttaaccaatggaaagaagatggttgccatgacagaaaatgacacagtaccaagtcttcaaaatctaaccgaggaaaaatcgggttggttatatttctgcccatggtatggtgagtatctcatgagttctgcaaataattatacaaaaacattaaaagagctttatcaaagcaattatgttattacgttggatgagttacctaacctaaaagttgatgatcaaacaccaagctcgacaatcacgccgacttctataacatttgataaatatacaccaaatcaaagcgataaaacaatttcgattgtgtttaatggaaatactttaaattcacttaaactaggtaccaccacattaaaaataaatgttgattacacattaagcggaaataatcttatattaaagaaaactttcctctcacaattaccaacgggtgaaagttctatcgtctttgactttgacaaagggaaagatcctgttttaaaagttaatgtcgtagattcaacgccaagtgctacaattactccggttaatgcaacctttgataaagcagttgataagcagcaaaatatcaacgtaacggtcaacttaaatgggctttcgcttgtaagtgttctaaataatagtaataaacttttactaaataaagattatacggtatcgggcaatacaattgttttacaaaaatcctatctatctacactatcacttggggaaagcaaattaacattccaatttagtgctggaaacaaccctgtattaacattgaatgtcatagataccactgctcccgtaattacaggaaatttagtaattcaagcctttaacggaaatacgagcgcatccaccaatggaatatcacctaaatttaagctgattaacactggaaacacagatatcaatctaagtgatataaaacttcgttattactatacgattgatggagaaatatcacagaacttctggtgtgattgggcaagtgttggtagtgaaaacgtaaaaggtgaatttgttaagcttgctaaaccagttagcggagctgattattacttggagatttcctttactgcttctgctggaacgttaaaagctgggcaaaatgcagaaattcaagcaagatttgctaagtcgaattggtcaaattacaaccaagcagatgattactcatttaatgcatccagtagccaatacgttaattctgacaaagttacgggatatttaagcaataagcttgtatggggaatcgagcca

SEQ ID NO: 130 - DNA, 1596 bp, Clostridium phytofermentans
atgagaaagcaaggcttctatctaatgtgtttgctgcttggtttatctgtaaacggatgtacatcacctggaacatcaggagagagtagtaatccaaaagatgttgttgtagacacagaagtcgtaaatacagaaacagtaaatacagatgctgcatgcacagataccccaagtacagttttaccctttactacactatcacctactatgataccgattgaacttgaagcggaagatgctgtacttagtggaaatgtaaagatagaaagtagcaaaagtggattttcaggaacaggatacattagcggattcgaagatgacagtgattattgtgaatttaagcttacgatagaggaagatggtttttatgatctaaacttcattagtgcagcgcttggtggatacaaagaaaattatgttttagtagatgatgaaaatgttggtgtagcagtaaccgatcaaagcaaattctcagattcgaaattagaaagaatatttcttacaaatggaactcataacattaagctatcaaaattctgggggtgggttgtcgtggataaattaatagtaacatcctccatagaactagatacgagtatctatgaagttcctgcaacattagtaaatcaaaacgctagtgatcgtacaaagagattgatgagttatttaaccgatatctacggtaaaaagtttttatctggtcaatattgtgagaaaggaatgtatggaacagaaatttctgcaatatggaaaacaacagaagggaaatttccagcagttctaggtcttgatcttatagattatacttcatcaagagtagaaaaaggtagcagttcgaaagctatccaatatgccatggaatttgatgaaaaaggcggtattgttacattctgctggcactggaatgcaccaacgaaatatctaactggaacatggtatcgtggtttttatacggaagaaacaaacatagatttggttaagattatgaacggtcaggatgatgaaggatatcaattgttgatgaatgatattgatgccattgcaaaagaactacttaaactaaaagaagcagatgtgcctattttatggagaccgttacatgaagcaagcggtgggtggttttggtggggagccaaaggtgcagaagcctataagaaattgtacatattattatatgaaaaactaacaaacgaatacgggctaaataacttaatctggctatggaatgggcaggataaggaatggtatccgggagatgaatatgttgatattatcggtgaggatatttatcctggtgaaaaagtttatacctctcagattaataaatatttaaaggccatgaattatacacaagcaaaaaagatggtcgtattatctgaaaatggttgtctgtttgacccggatttagcaattcgtgatggtgcaatgtggggattttttgcaacatggggtggcgaatttgttacaaaatccgctttgattaactggctatcagaacagtatacagaggagtatatggttaagaaggtctatgcccatgatagtgttataacactagataaactaccagacttaaagaattacccaatttatgaa

SEQ ID NO: 131 - DNA, 4245 bp, Anaerocellum thermophilum
tcattttgcggctggaactggcgctggttcattattgttgtagtatattgtaatattaatgtttttcccatttgtacctaagggtcgcttgtgatctaatccaacaaacctaccttgactgtcttgccaaagagccggctttaaaaatgagtattttttttcatcccatgtcgtaaaatcgtatccaaccatacctccagtgtcacctgagttagcattaaagcaccaaaatgtgtgatgaatatgattctctataatataatctcgtagatatctcatccacttttcgttatcagctccatcaagataaccaccccattcacctatcagcagcggcgcaatgttttcttccatgatgtaagcccaattcggacgccaacaatcttgtagtaaagattcttttgtgaagcctggataaaaccacggctgctggtaaacagagggtccgtaatcatgaggtgaatatactactttattttgatatttacccagattaataggatactttttaacacctcgcaagttaccgccccaccatgttgaatagtaatcgctataggattttgatgtccatgtaacgtcatcttttggatacgcttcaattccttctattacaataagaaggtttggatttatatttagtatacgtttcgcacatgtttcagccgcatatttccaattattaatatctgttgaattatcccattttgcaaatgttgtgtcttgccatggttttccatgtggctcattttttaggtcaaaagctataatagtatcatcatttttatatctatttgtaatccactcacacgccttataaaaatcctctggagtaaatttatcatcataccatactggatagatatgtcccattgcgtctgtttttatgctgtgaatatccaacataattttcaaaccaacttctttacatatttgtacaactatgtcaaatacttcaagactgtttttgccctcaagctctggattaacgtagtagtttatatttggttttggataaataccttgcgaccagttcagtataatctcggctgatattggaattcttagcaaattaaagcctctattggctatttcagctagagtatcttttagattgcaactccatacaccatcaaaaacatttgtacctgtattgtatccaaaccagttaatacctgttaaccataccggtttaccatctttatcaactattttattaccacttacataaagccaatcatcatttgtatcatcaagaatactcggtgttgatgttggatttggagttactgttggcattggtattactgtctgcaccggtgttggtgtcggtgtcggggttgccgttactgttggggtcggggttggtgttggtgctggtgttgctgtcggtgtcactgtcggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtgtttgttgtgctatttgtctccttgttagcatacaatacctttatctgtccacctgctacaggtgtactgctcggcgtcggtgttggggtagcagttggtgttggtgttggagtcggtgttggcgttggtgtagcagttggtgttggggtcggggttggtgttggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtgtttgttgtgctatttgtctccttgttagcatacaatacctttatctgtccacctgctacaggtgtactgctcggcgtcggtgttggggtagcagttggtgttggtgttggagtcggtgttggcgttggtgtagcagttggtgttggggtcggggttggtgttggtgctggtgttgctgtcggtgttggtgtcgctccactcggctcctgtccccataccaatacaccatctatatacgctgttaccttcacattctctccataactcgtcatgctctgcatccatgaccagtcattcccctgattgtaattgctccagtcactcttgttaaaccttatctgtatctcccctgtgtctttaccagcctgcaactgcccagctccactcttaaatcctatctctaaataatagtccgctccacttacgctactgctcagcttcacaaacttgaatgtcacattgcttgctcctatctgtgcccagtctgatatcgcactctgtgccttgtccccatctaccgtgtaccagtaccttatcgttaccctgctcaaatctatgctgctgcttccagtgttcactaccttcaaccatggccttatcgtatttgttgtgctatttgtctccttgttagcatacaatacctttatctgtccacctgctacaggtgtgctgctcggcgtcggtgttggtgttggcgttgctgttggtgtagcagttggtgttgacgttggtgttggtgtaggtgtcggtgttggagtcagtgttggtgttggtgttgctgttggtgtagcagttggtgtcggtgttggtgttgaagtaggtactgaagaggcaccaatcgcattagttttataccattgcccccatggagttggattattggggtcccaattgtttaccatgtccaagtaccctacatagctcgaattgccacaccaagaccagctaaaaagtcctatcttgtattgttttgcatacctgacaatagcttcctcgtcagggtcaccatctgtatgctgatgcccaaactccccaataactaatggcagccctttctccacaaatgacttgatatattcttctaccttgctcgctgtattgtatacaccgtacatatgaatcgaaaataccaaattgcgcagcggatctgcttccattatgctctgggcattgtctctcatagtattagaccaatcctgcccccagttcggtgcatcaaccattatcgtgtgcttgaaccctgcatcccttagcgcttttatagcattcttcgtgtcattaatccagttttgatagttattgttcccatacggctcattaccaatgtttattataacaaaatcctcattgccttctaacacactctttatctctttccaatattctactgcttgcgccaatgaacatgctgcaccgtcctcaccatatcctgtcgtgtcgtgaacttctaatacaatggctctgaatccaagacttcttgacaatgatataatatttgctacttcacttgctggtatcttcgtccatcgatagccattactcaacactaccctcacagagttcataccccatgaccttattcctcgcaatgccgtctcaagtttatctctgtaccagcaatgtgcgtgatttgttcctattaatgtgctagtatctatcttcactactccatcattagatgtagccgcaccaactttgggtaaattcgttacatttgctataaacaaaatgttcaataaaaaaacaactgtacatagtatactcaaccatttcttccccatttttgtttttactctcat

SEQ ID NO: 132 - DNA, 2649 bp, Scheffersomyces stipitis
atgttgttgcaagcttttttgtttttgttggctggttttgctgctaaaatttctgctacttttcaacaaccatccattgtggaatcaacattcaaagattggaagtacagagaatataagacatctgaatggaaattgtctagaactgatgcagaaaccaccgaaattcatgcagacctattagcaaataaggaaatcccagacccttttatggatacgaacgagagagatgtgcagtggatcggagagaaagattgggagtatggcaatgaatttttcgtttctgcaaacgctaagcctttatcagtacatgaattagtctttgaaggcctagatacttttgcaactgtttatctaaacaacgaggaaatcttgacaactgataacatgtttcgtgaatatagagtcgacgttacaaaatatctaaacttcgatggtgctaataacttgagaatcctattcaaaagtgctcttcatacggctagggctctagaaaggaaacatgggaagttgttttgcttcaatggcgaaagttcccgtgttcaagtccgtaaagctcaataccacttcgggtgggattggggtccagttctcataacatgcggtccatacaagcctgtcaaacttgtctcttacgattcatacattaaagacgtatacttcaaagtcgatgttaataaggaattaaaggcatcaatcgatatccagtctgatatctttactggttctagtagtagtaccctggaaattgaagtgaagtctccatctgggtccgttatacaaacattctcctctaaggttgataagtcagacattttctcacataagtttgccgtcgaggaaccagacttgtggtatcctttgggtcatggtaaacaatccttatatgagtttaagatcagtttagaaaatcaggttatcgtcaaaaaggtgggcctgagaaaagtcgaattagtacaagagtcctttgccgaacaagagggatcttccttctactttaaggtgaataacatccctatctactgcgcaggctcaaattggattccagcacactccatgcaaactcttttagtggattcagactacaagcagttattacaactaatgatcgacggacatcaaaatatggtcagaatctggggtggaggttactacgaacaggatatcttctacgatgaatgtgacagaatgggtatattagtttggcaagattttatgtttgcttgcggtcaataccctggttaccctgaatatttggaatctgttagcgaagaggcaaagcaccaattaaagagactgaggaatcattgttctctcgcgatatacgcaggtaataatgaagattaccaagtggcagagcagtttaatcttgagtgggacccaacagacaatagtggtgattactccaagtcaaactttccagccagaacactttacgaaacaattttccctaagctggtttctgaattttgtccagaaattccatatcatccaggctcaccttggggaggcaacggcactgcagatccaacagttggggacttgcaccaatggaacgtgtggcatggttcccaagagaaataccaagagtggcacaagttgggagggagattcatatctgagttcggaatggaggcattaccaaatagaaagactttcgaggcctgtattacagacccagacgaactgtacccacaatcagaaagtgtagatcaccataacaaagctgacggatttgaaagacgtttggctctttacgtcattgagaatatcaaagtgcaaggtttagacttcgacagctggatatacgccactcaacttatgcaagctgaatgtctaggatacgcttacagatattggagaagagaatggagaggtgacggtaagagatacacaggaggcgcaattgtttggcaaatcaatgattgttggccagtgacatcatgggctattgttgatttttacaaaagaccaaaattggcctactactcagttaaaagagaatcaagaccaatcggcttgggcatgtttaggaatgagaaaaagcatactcatgaacaggcaaaaccacattctacagctggacctcctcatgattactctcaagtagattacaatgttgatatttggggagtaaactccaataccgtagatcaacctgcggtattaaaggtggatatctacaatgtaacttcaggcaaaaagctggaatctcttccagatcaagatgttgttctaaaatctaactcttcaacagaatttgtttctgcccatccaattgccaatgaccaaccaatcgttgtctatagtagattcgtgagcaaagaggatggttcaataatagcctcagccggtgattggccacaacctctcaaatacttgaaatttcctggccgagaagttaagtttgaagtctctaatggttctatcaaattatcctcaaacaaacctgtaaaaggtgttgaaatcctagttgaaagagatgtatttctccaagataacggcttcgacctgtttccaggggatgaaaaagtagttatagcggaagatttgaaaaccacagacaaagttactgtaagatattatcaacaacaggatgatgatgacaaaggtggttctcctccttctcatcatcaccaccaccactaa

SEQ ID NO: 133 - DNA, 2850 bp, Aspergillus clavatus
atgcgcatcagggaacagacaatcctagcgttgctttccccagggctgcctccagtgaccggtcaacatgtcctcgatttgtctgagccaggatggactgtttcctcaaaagccctgaacagaacagtacctggtcgattgccatctcaagtacatttggatctttttgaggctggagttattgctacaatgggctctatgattttgactttcgctggactgagaatgccaaccggtagaacaccagccacgctactactaggctgtgaattgacagatcatgaaagtacatggttagtgtttgatggtttagacacattcactactattactttttgcgaccaaatcatcggttcaacttataaccaattcagacagtaccatttcgatgtttcccaggtcttgaaggaatgtaaacaggaaggcccagtactttcaatcaacttcggttctgcacctaacatagcgaatgctatcgcaaatggtccttctgctgaagagtggcctgccggagtccaaattacaaatgagtatccaaacagatggtacattagaaaggaacaatctgactttggctgggattggggaccagcatttgcaccagctggcccttggaaacctgcatatatcgttcaaaacaaaaacccagatcgattatacgtcctgaatactgaccttgatatctacagaagaggccaaattaaccatctacctccagatcaatcacaatcctgggttgtcaatgcctctattgacgtcctgggtagcgtgcctcaatggccttcaatgtcagttgaaatcaaagatgcttacagcggggtggttttatcttctggattgttagaaaacgtaacagtctcaggtaactctgtaactggtgtcactgtggttgatggtagaactcctaagttatggtggcctaacggtatgggtgatcaatccctgtacaatgtgacaattgcagtacacaatcaccgtaaccaagtcgtagcagaagtcatgaagagaacaggttttagaacaatctttctaaaccagagaaacattactgaggaacaattagctcagggggtagctccaggtgctaattggcattttgaaattaacgggagagagttttatgcgaaaggctcaaacataataccaccagacgcattttggccaagagtgactccatcccgtatggaaaggttgtttgatgctgttactgccggaaatcaaaatatgttgagagtgtgggcttcaggtgcatacttgcatgatttcatatacgatctggcggacgaaaaaggaatcttattgtggtctgagttccaattttccgacgcactttatcctgttgatgacgcttttctcgaaaatgtcgcggctgaagtggtttacaatgtcagaagagttaatcaccatccatctttggccttatgggcaggcggcaacgaaattgaatctctaatgctcccaatggttagaagagctgatcataaaggctatgcaaagtacgttggtgaatacgaaaaactctacatctcattgattttgccattggtgtacgaaaatacaaggtctatcacttattctccaagttcaactaccgaaggatacctacatgtgaatctttccgctccagtccctatgaccgaaaggtattccaatactaccccaggttcatactatggagatacggactattacaattacgatacaagcgtcagcttcaattaccataagtacccagttggcagattcgcaaatgagttcggtttccactcaatgccttccttacaaacttggcaacaagctgttgacccaaaggacctatactttaattctagtgtagtagttttaaggaatcatcattacacagcaggaggattgtttactgataattaccagaactctagtagagggatgggtgagatgacaatgggagttgaatcatactatcctattccatctaaaagtgatccagtggctaacttttccgcttggtgtcacgcaacgcaattgttccaagctgacatgtacaaagcacaaatacaattttacagacgaggatcagggatgccagaaagacaactcggatctttgtactggcaattagaagatacatggcaggccccaacatgggcaggtatagaatacgatggtagatggaaaatgctgcactacgttgcgagagatatctacgaacctattatcgtgtcaccattttggaactacaccacgggcgatcttgaagtttatgttacttctgatctttgggagccagctcaaggcaccgtgaatctaacatgggtggatttgagtggtaagtctatcgccggtaacgccggaacacctgaaagtatacctttttcagtaggtgctctcaatgccacagacgtttatagtgcgaatgtagctgatttgtcaccacctgaccttactgattctattttgatacttagcttagccggtgaaggttatcttccaaatgctagaacaagatcagagtttagacatgagaatcaattcacgcctgtttttccaaaggatctcgcactccgtgacccaaaattagagctggcttacaatcctgacacacgtacctttacagttgaggccactgcaggagttagtttgtacacttggttagattatcctgccggtgtagtcggctacttcgaacaaaatggctttgtattgttaccaggaatgaagaaagaaatcggtttcgttgttcaggaaggttctgtcgatgaggattggatgagaagcgtaaccgtcacatctttgtgggatcaaaaggttagagaagatgatgatgacaaaggtggttctcctccttctcatcatcaccaccaccactaa

SEQ ID NO: 134 - DNA, 2637 bp, Debaryomyces hansenii
atgttgttgcaagcttttttgtttttgttggctggttttgctgctaaaatttctgctacaatgacatcacaaactacttacaataccttatctaattggtcttacaagagagcaaataaggactcaacaaagtggcaaccatgtagcaaaaagactaatgggaaccaaattcacacagacttattgaataatggtgaaataccagaccctttcatagacaggaatgagaaagacctccaatggataggtgaagaggactgggagtataagacgacattcaaggtggatagcaacaaaaagcacgaattggtttttgaggggttggacacttttgcaactatctacgttaatgacaagcaggtactgacaacagataacatgtttcgtacttatacactagatgttactaattgctcccaggaatctaacgaattgagaatcgtttttaagtctgctttgaaagtatcaagagccttagaggagaaacatggtaagtttacctgtttcaatggcgaaacaagtagagtacatgctagaaaggctcaataccattacggctgggattggggaccactcttactgacgtgtggcccttggaaaccaatcaaactggttacttattccactgcgaagattaatgatttctatgttaaacaatctgttgacgaaaacctacaggcagaactatcattcgaagttgaagttgaatcaatttcagatgactgccaacttagcatcgaaattttctcttctgccggcaaattgatccgtacaattaaggagagcgcaaacaaatcctacaccttcgatccaattaagttagaagatccagaattgtggtacccaaaagggtatggaaagcaacctttatacaagtttgttgccaaactccatcaaacggaccaaattatcgactctgtagtttctgaagtcggagtgagaagagctagactggttcaagagccagttaaaggccaagatggttcatctttttactttgaggtcaacaacatcccaatcttttgtaatggttcaaattggattccaagccactccttttcctgcagtcttatcgatgatgattacgtcgacttgataagattggtggatgaaggtaaccaaaatatgataagagtatggggtggagggttttatgaaaatgacatcttatacaaacagtgcgataaacttggtatactaatctggcaggatttcatgtttggttgtgcaatatatcctggatacaaagagtttatagacaatgtcactcatgaagtgatcgaccaactaaagagactacgaaattactgttccatcgttttctacgtgggcaataacgaagattatcaggtcgctgaagatttgtacaagaagaacactttcacggatgaggaatttcctgccaaaaagctgtacgagagaatcttaccagatatggtatccaaattaacatcaggggtaggctaccaattcggttcaccaatctccccaggacaaggggtaccaactacagatgttaccgtaggagatatccatcaatggaacgtttggcatgggacacaggaaaaataccaagattggggaaaactcgttggtagattcgtttcagagttcgggatgttagcctttcctgacattaaaacccttaaggattgcattacagatgaaaaacaactttatccacaaagtgaaactatggatcatcataataagtctattggttttgagagaagattagcgctgtacgttatggagaatttctcagtctcttcaatggctctagcagattggatatacatcacacaactcatgcaatctgactgtctagcatacgcttacagaaactggaagagagaatggggttccaaaaatgagagaaaatgcggtggcgctctagtatggcaaattaacgactgttggccagtcacctcttgggccatcattgatttttaccatagaccaaaattagcctactacgcaattaaacgtgaatgtcaaccactaatgttaggcatctacaggacagaaactagattaagacagcctggtgaaccagacttggaaaaacaagcaccattacatgattacagtcctcgtgaatacacgattgacgtttggggtgtcaattctactttgcaagatttttctggtacattagaagtggagttgtatcattgtgaaaccggtgaactcgtgtctaatcttgagaaaagcaaaataacattggctcctaaccagactacagaattggtcacaaagtccaagatcgactccaataagctagtggtccatgcaaaattagttgattctgcgtcaaagctcgtttctaatacgagtgattggccacagccactaaagtacattatctggccaaaggatacaaaactggatgtttcaatccctgaaaacggaactattaagttgtcaacaaacaaacctgtgaaaggtatcgccctcaatatcgaaggagattattacctgcatgataattcaattgaccttctccctaataatgatcactatatcaaagtggataacctgcaaagtgacgatgtcgcaaagatatctgtcaactaccttaaagatgatgatgacaaaggtggttctcctccttctcatcatcaccaccaccactaa

SEQ ID NO: 135 - DNA, 2637 bp, Aspergillus nidulans
atgttgttgcaagcttttttgtttttgttggctggttttgctgctaaaatttctgctggcgctttcactcaacatgttctgtctgaaggctggtcttttaaagactctggcgatcaatctccagatgcatggttgtctgttcctacagtaccatcagttgtacaccaggaccttcaagctaatggcaaattggacgacccattcataggcctcaatgaattgagtgccagatgggttaatgaaaaatcttggacttacagaaatgtgttccaaaagccaactgttccagcaggtagttcaatatttctagtttttgatggtttagacacttttgccaaggtaaaactggacggccaagttattttggaatccgataatatgtttttagctcacagagtagatattacaaaggcactggacgttgaaggggagcataccttggagatcgactttgactgtgcacttctaagagctagagaactcagaaaacaacatccagatcataagtgggtgggcttcaacggtgacacagccagattaagcgttagaaaggcccagtaccattggggctgggattggggtccagttctaatgactgctggcatctggaaggaggttagattagaggtctattccgcaaaaatctctgacttgtggactgaggttcatctcgcggaggatcattctaaggcaaggattacagccgctgccgaggtcgagacacaaggtacaggtaactcctataaagctacttttacgctgtccctacagggacaacaaatcggtaaagaggtggctactttggatgggaatgtagcgaaaaccacatttgatgtgcaggagccttcattatggtggccaaacgggtatggtgatcaaactttatacgaaatatcagtctccctcgaaaaggaagaggaacaagcacaccaagtctctaaaaagtttggtatcagaacagctgaagtcatacaaaggcctgataaacatggaaaatcatttttctttagaatcaatggggtcgacatcttttgtggaggcgcttgttggattcctgcggattccttattgacaaatatcaccccagacagatacagaaaatggatcgaacttatggctgtaggtcatcaggttatgattagggtatggggaggtggtatctacgaggatgaatcattttatcaagcgtgcgatgaagtaggagtcatggtgtggcaagatttcatgtttggttgtggtaattatccaacttggccagaaatcctggaaagtatagagaaggaagctgaatacaacttgcgtagacttagacatcatcctagtattgtgatatgggtcggtaataacgaagattaccaagttcaggaacaacaaggattgacgtacaactatgctgataaagatccagaaagttggctaaaaaccgatttcccagcaagatacatctacgagcatttgttgccaaaagcagttcaaaagattatcccaagtgcttactaccatccagggagtccttggggagatggtaagatcacatcagatcctactgttggagatatgcatcagtggaacgtatggcacggaacacaagagaaataccagattttcgataccttaggtggtagattcaattcagaatttgggatggaagccttccctcacatgtcaactatcgaccattttgtaacaaacgaagcggataagtatccacaatctcacgttttagacttccataacaaagccgatggtcatgaaagacgtattgcaacttacttagttgagaaccttcgaactgcaaccgatctagaaacctacatttatctaactcaagttgtgcaagcggaaacaatgatgtttggatacagagggtggaggagacaatggggcgacgaaagacattgcggtggcgcattactatggcaactcaatgattgctggccaactatatcttgggctattgttgattacttccttagacctaaacctgccttctacgcagtctcacgagtactaaagcctcttgctattggtgttagaagagaacaccacgactggtccgtttcacacgctcaaccaccaaaaacatctaagtatgaactgtgggtagtgtcatcattattgaaggaagttattggcaaggttgagttaagattcatatccataaaaacaggcttagctatccatgaatcaatcgtcagagaaaacgtaactatcgtaccaaatggtacaacaaatatcctcgacggtgtcatcgatcatgccgtcgatgaaccacatgttctcgccgcaagactgtgggtggatggagaactcgtggccagagatgtggattggcctcaaccattcaagtacttagacctgtctgatagaggacttgaaattacacgtattagtaagacagaatctgaacaagtcttagaattgtctgcacgtaaacctgtgaagtgtttggtatttgaagagagagataatgtaagagttagcgactcagcaattgacattgtaccaggagatgaacaattcgttacaatcaaaggtcttaaacgtagcgatgcaccactaaaatacaaatttctaggacaggatgatgatgacaaaggtggttctcctccttctcatcatcaccaccaccactaa

SEQ ID NO: 136 - DNA, 2628 bp, Pyrenophora tritici-repentis
atgttgttgcaagcttttttgtttttgttggctggttttgctgctaaaatttctgctgcaaaatctcaatcattatcttgctacagacttagtgaaggatggtctttcaaacaaagtgacgacgccactaaaaacgcgtggatgccagttaaaaaggtcccaacaaatgtacaccttgatcttatagaagccggaaaaattccagatccattcctaggttttaatgaactacacgcagagtgggttgctgataaggcttggacttacaaggttgaattgccacaagtacaagaggcaaatgaaggaacaacacatgtcctggcttttgacggtttggatacatttgcaacagtccgtatcaacggcgaaactgttttggaatccgataacatgttcatcccacatagactagatgttactaaaaagctaagattaggcgagaaaaacatccttgagataggctttgcttcagctagattagaagcaattaagattaaggaaatgtaccctgaacacaaatgggttggctttaatggtgatatgtcccgtcttgctgttagaaaggcacaatatcactggggatgggattggggtccaatattgaatacttgtggtccttggagagaagtaagactagaaacatatcaagccagatttgaggacttaagagttgattacaagctggaatcaggattgaaatctgtgcatggtacagtgtctgctacagttcaaggagttagtgctgacagtgtttcattcgatgtgtttgatggggataaacaagtgtttaaggaaacagccaaaatttctaacggcgtagcaacagtagattttcatgttaataaccctaaactgtggtacccacatggttacggcgaacaaccactgtatactgtaacagccaccttattcgcaaatgatgttaaacttcatcaaacatcacgtagaaccggttttagaaaaggcgaacttatacaagagccagatgccattggaaagtctttttactttagagtaaacggggtcgatgttttctgtggtggttcagactggataccagcggactccttcaccccaagggtgaccgaagatcaatacagaagatggttggagttaatggttgatggttaccaaatcatgatcagaatttggggtggtggcatttgggaggaagatgtgttttacgatatctgtgacgaattaggagtattagtatggcaagacttcatgttcggttgtggaaactacccagctttccctgacatcttgagatcaattaaggaagagtgtactgctaacgtaacaagacttagacatcatccttcaatcatcatctacgccggtaataatgaagattaccaagttcaagagacttatgggctaacttacgattacgatgataaagaccctgaatcttggttgaaaacagattttcctgctagatatatctacgaaaagctgctcccagatgtggttgcggcagaatctccacatgttccatatcatcctggttcaccttggggagatggcttaaaaaccagcaatccaacggtcggagatatgcatcagtggaacgtttggcacggcacccaggaaaagtaccaaatctttgacactctaggtggtcgtttcaattccgaatttggtatggaagccttcccacatatcgatactgtcagatactggtgtacagatcctacacaattataccctcagtcacacatgatagactttcataacaaagctgatggacatgaacgtagaattgcaacgtatctcgttgagaattttagaactaaaactgatctagaatctttcatacatttgacacagttatctcaagcagaagcacttatgtttgggtacagaggttggagaaggcaatggggacagaatagacactgcggtggtgctctcgtttggcaattgaatgattgctggccagtgacttcatggtctattgttgattatttccagagaaagaaaccagcctactatgcaatgagaagagttctggctcctattgcagttgccgtgaagcgagcacatttcgactggagcgtagtccacgctagagtaccagccacaagtgactacgaagtatgggtcgctaatcagaagctagacgaagtggtcgccacagttgaattaagatacatctccgtgaaaagcggcaaagagatcaaggagaaaattgtcaaaaaggacattagactggtcccaaatggtacaactgacgtgctatcaggaaccattgacaaccgtaatgagcaacctcatgtgttggcagttcgtatatgggtcgatggtgaaatcgtatctagagatgttgactggccacaacctctcaaatacttagatttcgatgatagaggcgtagaagttattccaagaggggaaactattgtcgttagagcgcaaaaaccaactaaaggtttggtatttgaagagagatccggcgttttagtccatgattccgccatcgacctagtaccaggggatgagcagatcatcaaggtgagaggcttgggccctcaagataagccactgcgttggacctatttggggaaagacgatgatgatgacaaaggtggttctcctccttctcatcatcaccaccaccactaa

SEQ ID NO: 137 - DNA, 1452 bp, Aspergillus fumigatus
atgccatcgaagaaaccgttatccaactcaacagccttcagtctttcaaaaaattcccagatcactttctctgtccttggaattatgcacccattgccgtctgtcgccctcctatccgcgataggagctgtcgcggcgcaagttgggccttggggccaatgtggcggaagatcctatacaggagaaacatcctgcgtatcaggctggtcttgcgtgctattcaatgaatggtattctcagtgtcaaccagccacgactacgtcaacatctagcgtatccgccacagctgctccatcatctacttcatcttctaaggaatctgttccttctgccactacttctaaaaagccagttccaactgggtctagtagttttgtaaaagccgacggtttgaagtttaacattgatggggaaactaagtactttgccggcacaaatgcatactggttgccattcctaaccaatgacgctgatgttgattcagtgatggataacttacaaaaagcaggtttaaagattttgagaacatggggttttaacgatgttaattctaagccttccagcggaactgtgtacttccaattgcatgatccaagtaccggaacaaccacgattaatacaggtgcagacgggcttcaaaggttagactacgttgttagcgctgctgagaagagaggtatcaaattactcattcctttagtcaataattgggatgattacggaggtatgaatgcttacgttaaggcatacggtggaagtaaaactgagtggtacacaaactctaaaatacaatcagtttaccaagcctatatcaaggccgttgtctcacgttacagagattctccagcaatcatggcatgggaactgtctaacgaggcaagatgccaaggctgcagtacagacgttatctacaactggactgcaaaaacatcagcttacattaagtcactcgatcctaatcacatggtagcaaccggcgatgaaggtatgggtgtcactgtggactctgatggcagctacccatattcaacctatgaaggctctgacttcgctaaaaatcttgcagctccagacatcgactttggtgtatttcatctgtataccgaagattggggtataaaggataactcatggggtaacggttgggtgacatctcatgctaaagtgtgtaaagcggctggtaaaccatgtctatttgaggaatacggattgaaagatgatcattgttcagcttcattgacttggcagaaaacttccgtatcatctggcatggcagctgatttgttttggcaatatgggcaaacactgagtacaggaccttcaccaaatgaccattttacaatctactacggtacaagtgattggcaatgtggtgttgctgatcatttgtctactctggatgatgatgacaaaggtggttctcctccttctcatcatcaccaccaccactaa

SEQ ID NO: 138 - DNA, 1203 bp, Aspergillus niger
atgaagctttccaacgccctcctcaccctggctagcctggcgctggccaatgtttcaactgcgttaccaaaagccagtccagcaccttctacatcttcatcagctgctagtacttcatttgcatctacctcaggtttgcaattcaccattgatggggaaacaggttacttcgctggcactaactcttactggataggtttcctaacagacaatgctgacgttgatctagtcatgggccatctaaaatcatctggccttaaaatccttagagtatggggttttaacgacgtgacatctcaaccaagttcaggaacagtgtggtaccaattgcaccaagatggtaagtctactattaacacaggcgcagatggtttgcagagactagattacgttgtttcctccgcagaacaacatgacataaagttaatcatcaattttgtgaattactggactgattacggagggatgtcagcatacgttagtgcttacggaggctctggagagacagacttctatacctctgatacaatgcaatccgcttatcagacatatatcaaaacagtagtggaaagatactcaaacagttctgcagtattcgcttgggaattagcaaatgagccacgttgcccaagctgtgatacatctgttttgtataattggatagaaaagacctccaagtttatcaaaggtttagatgctgacagaatggtttgtattggtgatgaaggctttggcctgaatattgattctgatgggtcatacccttaccaattttccgaaggattgaactttactatgaacttggatattgatactatcgattttggtactttacatttgtacccagatagctggggaacgtctgacgattggggtaatggttggatcacagcacatggcgctgcctgtaaagcggcagggaaaccatgcttgttagaagagtacggtgtcactagcaatcattgctcagtcgaaggcgcctggcaaaagactgctctttctactacaggtgtaggtgcagacttattctggcaatacggagatgacttgtcaacgggaaaatcccctgatgacgggaataccatctactatggtacatcagattatcagtgtctagtcactgaccatgttgctgccattggatctgccgatgatgatgacaaaggtggttctcctccttctcatcatcaccaccaccactaa

SEQ ID NO: 139 - DNA, 1158 bp, Chaetomium globosum
atgaaagctatcttcaccctcggtctcagcctgctgtccgcggcgcaagccttgccatctgctagagcagccgcatctagcacagtggatgggactagattttccattgatggaaaaacagggtacttcgccggaactaactcatattggataggcttccttaccaataatcaagacatcgacacaacactagatcatatagctacaagtggtctaaagatcctcagagtttggggtttcaatgatgtaaacactaagccaggtgctggaactgtctggtttcaattgttgagttcctccgggagtcagattaacacaggaacagatggtttacaaagattggactacgtggtacagtccgcagaaaagaggggagttaagttgattatcaatttcgtcaacttttgggacgactatggcgggatgaacgcctacgttaaggcttttggtggatcaaaggaatcttggtacactaacgcaaatgcccaagcacagtacaaaaagtacattgaggccgttgtttctagatactctaagtctgacgcagtttttgcttgggaattggctaatgaacctcgttgtaaaggctgttctacggatgtaatatacaaatgggcaaccgatatctcagcgtacattagatcattagattcatctcacatgatcacacttggtgatgaaggcttcggtctgccaggtgatacaacctacccataccaatatacagaaggcactgatttcgtgaaaaatcttggaattaaagacttagactttggcacgtttcacatgtatccagattcctggggtgttccatattcatttggtgaaggctggatcaaatcacatgctgccgcatgtaaagctgcaggtaagccatgcttgttggaggaatacggcgcaaacgcttcatgtgatatccaaaaaccttggcaacaatcatctcttgccctagctgctgatggaatgtctggtgacctattttggcaatggggtgatcaattaagctctggacaaactcataatgatggcaatacagtatactatgggagtgagttagcgacttgcttagtcactgaccatgtcaaagctattgaagctgcatcagatgatgatgacaaaggtggttctcctccttctcatcatcaccaccaccactaa

SEQ ID NO: 140 - DNA, 1215 bp, Aspergillus nidulans
atgaggctcattcacgctgtgcttggtcttcttgccggtgcggctcccgcccttgttgcagccagccccgcagccccaattggcaatggtagggatcaagtatctaaggcagtcggccgtcatttcgagatcgacggcaaagttcagtattttgccgggacaaattgctggtggctaggaaatctcttgaatgattttgaagtggaattggctgttagccaaattgcagagacaggttataaagtggttagaacctggggtttctttggcgttaatgatccaagtaatccaggtcaaccagtctattaccaagtcttaaacgaaagtctatacgaaggagggttaggtatcaattacggatcaaatggtattagaagattggatactgtcgtatccctagcagagagatatgatatacaattagtgctgactttcatgaataattggaacgactttggcggcatcaacatctactcaaacgcttttggatctaacgccacaacatggtatacagataaaaagtcacagagagcatacagagagtacatcaaattcatcgttaatcgttacaaaggatcttctgctatctttgcgtgggagttgggtaacgaaccaagatgtaagggttgtgacccaagtgtcatatacaactgggcaaaatccgtgtcagcatacatcaaaaagttagataagaaacacatggtagcccttggcgacgaaggttggttatgtcctccagaaggagatgggacttacgcttacgattgctctgaaggcgtcgactttgttaaaaacttggaaatagagacattggattatggtacatttcatctctacccagaatcttggggatacaattactcctggggttcagaatgggttttacaacatgacgctattggaaagagattcaacaaacctgttgtattcgaggaatatgggacgcctttgaatcatactcagctggaaagaccttggcaattgaccactgttaaggaaacacaagtcgcggctgatttcatttggcaatttggaactgttctgccagtagaaggtactgaatggggcgacgttaattcaatatactacggtaccgaggaatacgaagttctagctgtgcaacatgcttgggaaatggctagaaagaaagtaccaagacacgatgatgatgacaaaggtggttctcctccttctcatcatcaccaccaccactaa

SEQ ID NO: 141 - DNA, 1590 bp, Arabidopsis thaliana
atgagacaccttagctcacctccatggcctctcctccttctcctcctcctctcttctttcacctccggcgaatcatcattgtccgctgagaaaaacaagttgcatactggcggtttgtctaggcaaagtttcccaaagggttttgtctttggaacagctacctctgcttatcaagttgaaggagaaacacatcaggatggccgaggcccatccatttgggatgcctttgtgaaaatccctggtaagatcgctaaaaatgccacggctgagattactgtcgaccagtaccatcgttataaggaagatgtagacctgatgaaaaagctaaactttgatgcttacaggttctccatctcatggtctagaatttttcctgaaggttctggaaaagtgaattggaaaggtgtcgcatattacaacagacttatcgattacatggttcaaaagggcattactccatacgcaaatctgtatcattacgacttaccactagcattagagaacaaatacaagggtctacttggcaggcaagttgtaaaggattttgcagactacgctgagttctgttacaagacatttggagatagagtgaaaaattggatgacttttaatgaaccacgtgttgtcgctgctcttgggtacgataacggtatattcgcacctggcagatgttctaaagcatttggaaattgcacagaagggaatagcgccacggaaccatatatcgttactcatcatttgatactagcgcacgccgcagcagtacaaagatacagaaagtactaccaggctaaacaaaaaggcagagtgggaatcttattagatttcgtttggtatgaaccactgaccagatcaaaagctgataacttggctgctcaaagagccagagacttccatatcggatggtttatccatccactcgtttatggggaatatccaaaaacaatgcaaaatatcgttaaggaaagattgccaaagttcacagaaaaggaagtgaaaatggtaaaagggagtatagactttgtcggtattaatcaatatacaacttactacatgagtgaaccacatccaacaactaaacctaaagatttgggctatcaacaagattggaacgttgagttcggttttgctaagttaggaaaaccaataggtccacgtgcatactcaagttggttgtacaatgtcccttgggggatgtacaaagccttgatgtacatgaaagagagatacggtaatccaacaatgattttgtcagaaaacggtatggacgaccctggtaacgtaactttagcgcaaggtctacacgatacaactagaattaagtactacaaagattatttgactaatttgaaaaaggcgagagatgatggtgcaaatgtggtaggttactttgcctggtccttattagacaattttgaatggctgtcaggatacacctctagattcggcattgtttatgttgattacaaaacattgaaaagatacccaaaaatgtctgcccaatggtttaagcagttactgaagagaaacaataaggatgatgatgacaaaggtggttctcctccttctcatcatcaccaccaccactaa

SEQ ID NO: 142 - DNA, 1581 bp, Hordeum vulgare
atgaggtcctccccggtgctgttgctggtaatagcactggtggcggctgctcacctggcgccattagagtgtgacggtcctaatccaaatccagaaattggtaatactggaggattgtcaagacaaggctttccagcaggttttgttttcggaactgcggcctctgcctaccaagttgaaggcatggcaagacagggtggtagaggcccatgcatttgggatgctttcgtcgctattccaggtatgatagcaggaaatggtactgctgatgtcaccgtagatgaataccataggtacaaggaagatgttggtatcatgaaaaacatgggtttcgatgcctatcgtttctctatcatttggtctagaatttttccagacggtacaggtaaagtaaaccaggaaggtgttgattattacaacagattaattgattacatgcttcaacaaggaataactccttatgccaacctataccattacgacttaccactcgccctacatcaacaatacttgggctggctatccccaaaaatcgtcggtgcctttgctgattacgctgaattttgctttaaggtgtttggagacagagtgaaaaattggttcacttttaacgagcctagagtggttgctgccttagggtacgataatgggtttcatgctccaggtagatgttcaaagtgtcctgctggcggtgatagtagaacagaaccttacatcgttacgcataatatcatactctctcatgcagcagccgtccaaagatatagagaaaaataccaaccacatcagaaggggagaatcggaatattacttgactttgtatggtacgaacctcattccgatagtaatgcagatcaagctgcagcacaacgagcaagagattttcacatcggttggttccttgaccctatcacaaatggtagatatccatcaagcatgttgaaaattgttggtaatagactccctggattcagtgctgatgaatctcgaatggtgaagggctctattgattatgtcggcatcaaccaatacacctcatactacatgaaagatcctggtgcctggaatcaaactccagtctcttaccaggatgactggcatgtaggctttgtttacgagagaaacggagttccaatcggtccaagagccaattctgattggttgtatatcgttccttggggcatgaataaggctgtaacttatgtcaaagagagatatggtaacccaacaatgattttgtctgaaaacggaatggaccaaccagggaatgttagcatcgcagacggcgtacatgacacagtgcgtatcagatactacagagactacattaccgaattgaaaaaggctattgacaatggggctcgtgttgcaggctactttgcgtggagtttgctagataacttcgaatggagacttgggtacacagctagatttggaatagtttacgtcgatttcaatacattaaagaggtatccaaaagattcagctttatggttcaaaaacatgttgtcagagaaaaagagatcagatgatgatgacaaaggtggttctcctccttctcatcatcaccaccaccactaa

SEQ ID NO: 143 - DNA, 1557 bp, Oncidium Gower Ramsey
atgaatcccttcttcctactcatcttcttattcccgcggacctctcagccggtggccgctgctccagttgcaggtagcagaacagatgcaggtgggctgaacagagacaatttcccagttggttttacctttggaactgctgcttcagcataccaagttgaaggtatggcgttaaaggatggcagaggtccatccatttgggatgagtttatcaaaattccaggggaaatcaaaaacaatgccacggctgcagtcactgttgatgaatatcacagatataaagtagatattgatataatgaaaaacatgaattttgacgcttataggttctccatatcatggtctagaattttccctaatggtagtggtaaggtaaactggaagggtgtcgcttactacaacagattgattgattacatgttacaacagggaattacaccatttgcgaatctttatcattacgatctcccagaagcattagagaagagttacaatggtttgttgagccgaaacgtcgtgaaggattacgctgattacgcagaattttgtttcaagacttttggcgacagagtcaaaaattggtttacttttaacgagcctcgtgttgtagcagcgcttggctacgacaatggtatcttcgcaccaggcagatgcacaggatgtactgccggaggcaactcaaccacagaaccatacatcgtagcacacaacttgatactttctcatgcagccgctgttaaaagatatagagacaagtaccatgtttcccagaaaggtagaatcggcatcttgctggatttcgtctggtacgaacctttgacaaactctacagatgatgaagctgccgctcaaagggccagagactttcatatagggtggtttctgcatccaatcatatacggggaatatccaaaatctgtacaagatattgtcaaagagagactccctacttttacagctgaggaaatctctatagttaagggatcagttgattacttgggggttaatcaatatacatcttactacatgtttgaccctcatctaccaacacaaacgagtaccggttaccaaactgattggaacgtgggtttcgcctacgaaagagatggagttccaatcggtccaagagcgaatagtgactggttgtacattgtgccttggggaatgtacaaggccgtgacttacgttaaggaaaattaccaaaatcctactatcattctgtccgaaaatggaatggatgatccaggtaatgtctctttaacagttggagttcatgacgcaacaagattgaattactacaaatcttatatctcagagcttaaaagggctattgatgatggcgcaacagtaatcggctattttgcctggtcactactagacaattttgaatggaagttaggctacacatcaagattcggaattgtatatgtggactttaaaactttgaaacgttatccaaaaatgtcagcctactggtttaaagacgtgttacaaaagaagaaagatgatgatgacaaaggtggttctcctccttctcatcatcaccaccaccactaa

SEQ ID NO: 144 - DNA, 1590 bp, Zea Mays
atgcagagctccgtaaagctcgcggtgcttgctcttctgctagcggcagcagctcatcatggtttgttgccattaccaactgcaagatgttattggctcaatccagaaatatacgacgccggaggtctatcaaggagggcattccctgacggtttcgtttttggcactgctgcctcagcataccaagttgaaggcatggctaaacacggcggaagaggtccatcaatttgggatgcctttatagaagttccaggaacaattcctaataatgccacagctgacgtgacagttgatgaataccacagatacaaggaggatgtaaacatcatgaaaaacatgggttttgatgcatacagattttccatctcctggtccagaatatttcctgacgggacaggtaaagttaatcaggaaggcgtagactactacaacagactcattgattatatgttacagcaaggaatcgcaccatacgctaatttgtaccattacgatttgccattagcgttgcatgaacaatacttgggatggttaagtccaaagatcgtcgaagcgtttgctgattacgccgaattttgtttccatgctttcggagatcgtgtcaaaaattggttcacattcaatgaaccaagatgcgtcgcggctttaggttatgataatgggcttcatgcaccaggtagatgttcaggttgccctgctggaggtaattcaactactgagccttatcttgttgcccatcatttgatactgtctcatgcagctgccgttagacgttatagagacaagtatcaattgcaccaaaaaggtaaaattggtatcttgctagattttgtatggtacgaaccattttcagacagtaacgctgatcaagctgcagcacaacgagccagagactttcacctaggttggttcctggacccaattgtacacggaagatacccatactctatgcaagagattgcaaaagatcgattaccattattctcagatgaggaagctagaatggtcaaggggtctatcgattatgtcggcatcaaccattatacaagtttttacatgaaagatcctggcacttggaaccttacccctgtgtcttaccaagatgactggcatgtcggattcgtctacgaaaggaatggtgtacctattggcgcacatgcaaatagttactggctctacatcgtgccttggggtataaacaaagctgtttcatacgttaaggaaacttacaaaaatccaacaatgattttagccgaaaatgggatggatcaaccaggtgatgtttctatcacccaaggcgttcatgacaccgtgagaattagatactatagagattacatcactgagttgaaaaaggccatcgacgatggtgctagagtaataggatattttgcttggtctttgttggataactttgagtggagattaggctatacgtctagatttggcctagtttacgttgactacaagacactaaagagatacccaaaagatagcgccttttggttcaaacacatgctgtctaaaaagagatcagatgatgatgacaaaggtggttctcctccttctcatcatcaccaccaccactaa

SEQ ID NO: 145 - DNA, 1602 bp, Oryza sativa
atgggccaccgcctcgtcgttgtgcttctgctggccttattagtagctggagccgcgcgcgcggccgaacaagcagccggtgaagatggaataagaggtggcgctggcgctgatcatcaagaggcagctggcatcacagggggtttatctagaagatccttcccagcaggatttgtgtttggaactgccgcttcagcctaccaggtcgagggtatggccttgaaggacggtagaggaccaagtatttgggatgcttttgtaaagacgccaggcgaaatcgcaaacaatgctacagctgacgtcaccgttgatgaatatcacagatataaggaagatgttaatatcatgaagtcaatgggttttgatgcttacagattttctataagttggagcagaatcttccctaccggcacaggtaaagtcaattggaaaggagtcgcctactataatagactcatcaactacatgttgaagattggtattacaccttacgctaatctttatcattacgacctacctgaagcactagaggtacaatacgggggattgttgaaccgtaaaatagttgaggcttttgctgattatgcggaattttgtttcaaaacattcggtgatcgtgtgaaaaattggatgactttcaatgaaccaagagtggttgccgctctgggatacgatgacggcaatttcgccccaggaaggtgtacaaaatgcacagctggtaacagtgcaactgaaccttatattgtagcacatcatttgattctgagtcatgcttccgctgtacaaaggtacagacataagtaccagcatatacaaaaaggtaaaatagggatcttattggattttgtgtggtatgagggtttaacaaactctactgctgatcaagctgcagcgcaaagatcacgagactttcatgtcggttggttcctgcatccaatcatctacggcgaatacccaaaatcacttcaagtgatcgttaaggaaagactaccaaaattcaccgccgatgaagttcacatggtaaagggttccatagactacgttggaatcaatcaatacactgcatactatgtcagagatcagcaacctaacgctacaacattgccaagctactcttctgactggcacgcggcaccaatctacgaaagagatggcgttccaatcggtccaagagctaattctgattggttgtacattgtaccttggggtttgtacaaggcagttacttatgttaaagagaaatacggtaatccaactatgtttctatctgaaaatggaatggacgatccaggcaacgttacaattgcacaaggcgtacatgatactactagagttgcttactacagatcctacattactaagttaaaggaagcaattgatgatggtgcaaactgtattggttattttgcgtggtcattattagacaattttgaatggaaactagggtacacgtcaagatttgggttggtctacgtggacttcagaacccttagaagataccctaagatgtcagcatattggtttcgtgacctcgtttcctctaaaaacgatgatgatgacaaaggtggttctcctccttctcatcatcaccaccaccactaa

SEQ ID NO: 146 - protein, 390 aa, Neosartorya fischeri
MKFSFLTVASFLIGQVALAALSAKKFASASDLQFTIDGKTGYFAGSNSYWIGFLTNNADVDLVFDHMKESGLKILRVWGFNDVNTVPGQGTVYYQVHANGKSTINTGADGLQRLDYVVHSAEKRGIKLIINFVNNWDDYGGMNAYVKAYGETDHNAFYSNKNIQNAYRRYVKAVVSRYTNSPAVFAWELANEPRCKGCDTEVLYEWIKSTSEYIKKLDKRHMVCIGDEGFGLDLLSDGSYPYTYVEGSNFTRNLAIPTIDFGTFHLYPDSWGTTHEWGNGWAQSHGAACKAAGKPCLFEEYGVTSNHCALETPWQKTSLNTTGVSGDLYWQYGDTLSTGQSPNDGNTIYYGTDEFKCIVKDHVAAIKAKQGWVDDDDKGGSPPSHHHHHH

SEQ ID NO: 147 - protein, 377 aa, Aspergillus aculeatus
MKLSHMLLSLASLGVATALPRTPNHNAATTAFPSTSGLHFTIDGKTGYFAGTNSYWIGFLTNNDDVDLVMSQLAASDLKILRVWGFNDVNTKPTDGTVWYQLHANGTSTINTGADGLQRLDYVVTSAEKYGVKLIINFVNEWTDYGGMQAYVTAYGAAAQTDFYTNTAIQAAYKNYIKAVVSRYSSSAAIFAWELANEPRCQGCDTSVLYNWISDTSKYIKSLDSKHLVTIGDEGFGLDVDSDGSYPYTYGEGLNFTKNLGISTIDFGTLHLYPDSWGTSYDWGNGWITAHAAACKAVGKPCLLEEYGVTSNHCAVESPWQQTAGNATGISGDLYWQYGTTFSWGQSPNDGNTFYYNTSDFTCLVTDHVAAINAQSK

SEQ ID NO: 148 - protein, 931 aa, Aspergillus niger
MRHSIGLAAALLAPTLPVALGQHIRDLSSEKWTLSSRALNRTVPAQFPSQVHLDLLRAGVIGEYHGLNDFNLRWIAAANWTYTSQPIKGLLDNYGSTWLVFDGLDTFATISILWTANRIHGQSVSPVSGSMYLPALEACQRRILIRKVSFRGGVTAEVNTCYLHIEWPDDVQLTYEYPNRWFMRKEQSDFGWDWGPAFAPAGPWKPAYIVQLDKKESVYVLNTDLDIYRKNQINYLPPDQSQPWVVNASIDILGPLPAKPTMSIEVRDTHSGTILTSRTLNNVSVAGNAITGVTVLDGLNPKLWWPQSSVIRTSTMFLSLSKVEGTRPWPVWTNGRASAPFFLNQRNITEVQRAQGIAPGANWHFEVNGHEFYAKGSNLIPPDSFWTRVTEERISRLFDAVVVGNQNMLRVWSSGAYLHDYIYDLADEKGILLWSEFEFSDALYPSDDAFLENVAAEIVYNVRRVNHHPSLALWAGGNEIESLMLPRVKDAAPSSYSYYVGEYEKMYISLFLPLVYENTRSISYSPSSTTEGYLYIDLSAPVPMAERYDNTTSGSYYGDTDHYDYDTSVAFDYGSYPVGRFANEFGFHSMPSLQTWQQAVDTEDLYFNSSVVMLRNHHDPAGGLMTDNYANSATGMGEMTMGVISYYPIPSKSDHISNFSAWCHATQLFQADMYKSQIQFYRRGSGMPERQLGSLYWQLEDIWQAPSWAGIEYGGRWKVLHHVMRDIYQPVIVSPFWNYTTGSLDVYVTSDLWSPAAGTVDLTWLDLSGRPIAGNAGTPKSVPFTVGGLNSTRIYGTNVSSLGLPDTKDAVLILSLSAHGRLPNSDRTTNLTHENYATLSWPKDLKIVDPGLKLGYSSKKTTVTVEATSGVSLYTWLDYPEGVVGYFEENAFVLAPGEKKEIGFTVLDDTTNGAWVRNITVQSLWDQKVRG

SEQ ID NO: 149 - protein, 937 aa, Aspergillus aculeatus
MRALPTTATTLLGVLFFPSASRSQYVRDLGTEQWTLSSATLNRTVPAQFPSQVHMDLLREGIIDEPYNDLNDFNLRWIADANWTYTSGKIEGLGEDYESTWLVFDGLDTFASISFCGQFVGATDNQFRQYMFDVSSILKACPEEPTLGIQFGSAPNIVDAIAQDPSSPTWPEGVQITYEYPNRWFMRKEQSDFGWDWGPAFAPAGPWKPGYVVQLKQAAPVYVRNTDLDIYRLGQINYLPPDQTQPWVVNASLDYLGSLPENPSMAIEVKDLQSGEILASRPLTNITVTEGSVTGVTVLEGVDPKLWWPQGLGDQNLYNVTISVTDGGNQSVAEVTKRTGFRTIFLNQRNITDAQLAQGIAPGANWHFEVNGHEFYAKGSNLIPPDCFWTRVTEDTMTRLFDAVVAGNQNMLRVWSSGAYLHDYIYDLADEKGILLCSEFQFSDALYPTDDAFLENVAAEVVYNVRRVNHHPSLALWAGGNEIESLMLLLVEAADPESYPFYVGEYEKMYISLFLPLVYENTRSISYSPSSTTEGYLDIDLSAPVPMAERYSNTTEGEYYGDTDHYNYDASIAFDYGTYPVGRFANEFGFHSMPSLQTWQQALTDPADLTFNSSVVMLRNHHYPAGGLMTDNYHNTVARHGRNDPGRAGLLPDAQHSVRPRGQLQRLVPRDPALPGGPLQVTNPVLPAGQRAARTPARVPVLAARGHLAGALVGGDRVRRPLEGPHYVARDIYKPVIVSPFWNYTTGALDIYVTSDLWTAAAGSVTLTWRDLSGKPIASNGGLPTKPLPFHVGALNSTRLYRMNMKQQPLPRHEDAILALELTATGSLPNTDEEVTFTHEQWFTPAFPKDLDLVNLRVRVEYDAPLGKFAVEATAGVALYTWLEHPEGVVGYFEENSFVVVPGQKKVVGFVVQADETDGEWVHDVTVRSLWDLNEGE

SEQ ID NO: 150 - protein, 930 aa, Neosartorya fischeri
MHVKAETVLALLTPGLPSVVGQHVVDLSGDGWTLSSTALDRTVPGHLPSQVHLDLFEAGVINITASMILTFVGLLMPIGRIPATRLKACDLENFESTWLVFDGLDTFTTITFCDQHVGSTDNQFRQYHFDVSQILKECKQDPVIRINFGSAPSIANAIAKSPDAEEWPPGVQITNEYPNRWYIRKEQSDFGWDWGPAFAPVGPWKPSYIVQNNHAELYVLNTDLDFYRQGQINYLPPDQSQPWIVNASIDILGPVPWKPSMSIEIKDAATGSVLSSGLLQNVTVSGNSITGTTTIDGDAPKLWWPSGMGEQNLYNVTVTVQNDKKKSLAKVTKRTGFRTIFLNQRNITDDQLAQGIAPGANWHFEINGHAFYAKGSNIIPPDAFWPRVTQARMARLFDAVTAGNQNMLRVWASGAYLHDFIYDLADEKGILLWSEFQFSDALYPVNDAFLENVAAEVVYNVRRVNHHPSLALWAGGNEIESLMLPMVKRADPTGYSKYVGEYEKLYISLILPLVYENTRSITYSPSSTTEGYLYVNLSAPVPMAERYSNTTPGSYYGDTDYYNYDTSVSFDYNHYPVGRFANEFGFHSMPSLQTWQQAVDPEDLHFNSSVVMLRNHHYTAGGLFTDNFKNSSKGMGEMTMGVEAYYPIPSKSDSVANFSAWCHATQLFQADMYKSQIQFYRRGSGMPERQLGSLYWQLEDIWQAPTWAGIEYDGRWKVLHYVARDIYQPIIVSPFWNYTTGRLEVYVTSDLWEPAQGTVNLTWVDLSGKTIANNAGTPETVNFTVGALNTTNIYTTNISELSLPDLKDSILILSLSGEGRLPNTSSKKAFVHQNHFTPVFPKDLSLKDPKLEISYSPESRKFTVQATGGVSLYTWLDYPAGAVGYFEENAFVLLPGVQKEVSFAAQEGNVTDDWVRRVTVQSLWDQKVRD

SEQ ID NO: 151 - protein, 821 aa, Saccharophagus degradans 2-40
MVVNTDITQWSLTKTNANGAQTPADIIPLQQWLAVPVPGTVAQAVGDAGPQEDLEQFDWWYTAQFPLPKTGKRTYLQCDGLATLSEVWVNDQQVLYSQSMFENHKLDITDYLQADNTLAIVFKALAPHLAERRARPQWKTNLVDNQNLRWFRTSLLGRMPGWTPPVKAIGPWRDISIVSVAKFDLVECTVFSEVDEALNGKVHINLELDFIDAKLAADPQIQFLLDGKIYPITAKPIKGGGAFIDTEIAIEQPQLWWPHTHGEPYLHAYKITAIIDGEVTTLTEGKLGFKRVTAANQTNQLALEVNNNKIFCRGACWATPNITSLNASKQEYRHLLKLLVDAGANMVRIGGTMVYEHDDFYALCDELGILVWQDFMFANMDYPFADEDFSKLVAKEVRQQITRLKQTASIAVFCGNSEMQQQAAMMGMEQTQWANALFDTFITQKLEEQQLTLPYFTSSPCEGGLPFHTDAGLTHYYGVGAYKLMPDHFTVREVGFTSECLGFSHIPVTASLKQAFESPYPATHTPSWKAGIPRDNSAGWDFEDIRNFYLEKIFGVVADTLRYSDPETYFKLATIATAEMVSSVYSIWRASISNCNGALAWFYQDIVAGAGWGIVDSFARPKAAYYFLKRVWQPQQVLLINNSLNGYTLEVQNETAHTLQAQLNIVLVGLSDNIVAEHTQEITLAANSVGTHKLDTVFGRFMDATHAYKFGRQTIYAVVAELRNESGELISQAVSFPGCRRINTGAGEITGSITSDSDNESVVTLTPSVFVEYACLESKTTQFSDNYTCMLPGKTYSFKACEQIKSVHVSTLNLQKEFRVT

SEQ ID NO: 152 - protein, 857 aa, Clostridium phytofermentans
MKGLVKKVSTFIIALSLLFSFITVPVSAGTALFVIESENTRLSSELQVVTAIYGQPKPGYSGAGFVWMQNSGTLTFDVTVPETGMYTISTRYMQELSTDGRLQYLSVNGINKGSFMLPYTTVWSDFNFGIYKLTKGSNTIQIKAGWGFAYFDTFTVDYAKLDSLNVAPTLTDSQATSETKLLMKYLTEVYGKHIISGQQEIYGGGNNGNSELEFDWIHNLTGKYPAIRGFDFMNYNPLYGWEDGTTNRIIDWVNNKNGIATGCWHITVPKDFNSYKLGDFVDWQKTTYKPTETNFKTANAVIPGTKEYQYVMLTIDDLAKQLLILQQNNVPIILRPYHEAEGNGGANGEGAWFWWASAGAKVYKQLWEMLYTRLTQTYGLHNIIWTYNSYVYSTSPAWYPGDNLVDIVGYDKYNTVYNRYDGLSGVPNEDAITTIFYQLVDLTNGKKMVAMTENDTVPSLQNLTEEKSGWLYFCPWYGEYLMSSANNYTKTLKELYQSNYVITLDELPNLKVDDQTPSSTITPTSITFDKYTPNQSDKTISIVFNGNTLNSLKLGTTTLKINVDYTLSGNNLILKKTFLSQLPTGESSIVFDFDKGKDPVLKVNVVDSTPSATITPVNATFDKAVDKQQNINVTVNLNGLSLVSVLNNSNKLLLNKDYTVSGNTIVLQKSYLSTLSLGESKLTFQFSAGNNPVLTLNVIDTTAPVITGNLVIQAFNGNTSASTNGISPKFKLINTGNTDINLSDIKLRYYYTIDGEISQNFWCDWASVGSENVKGEFVKLAKPVSGADYYLEISFTASAGTLKAGQNAEIQARFAKSNWSNYNQADDYSFNASSSQYVNSDKVTGYLSNKLVWGIEP

SEQ ID NO: 153 - protein, 532 aa, Clostridium phytofermentans
MRKQGFYLMCLLLGLSVNGCTSPGTSGESSNPKDVVVDTEVVNTETVNTDAACTDTPSTVLPFTTLSPTMIPIELEAEDAVLSGNVKIESSKSGFSGTGYISGFEDDSDYCEFKLTIEEDGFYDLNFISAALGGYKENYVLVDDENVGVAVTDQSKFSDSKLERIFLTNGTHNIKLSKFWGWVVVDKLIVTSSIELDTSIYEVPATLVNQNASDRTKRLMSYLTDIYGKKFLSGQYCEKGMYGTEISAIWKTTEGKFPAVLGLDLIDYTSSRVEKGSSSKAIQYAMEFDEKGGIVTFCWHWNAPTKYLTGTWYRGFYTEETNIDLVKIMNGQDDEGYQLLMNDIDAIAKELLKLKEADVPILWRPLHEASGGWFWWGAKGAEAYKKLYILLYEKLTNEYGLNNLIWLWNGQDKEWYPGDEYVDIIGEDIYPGEKVYTSQINKYLKAMNYTQAKKMVVLSENGCLFDPDLAIRDGAMWGFFATWGGEFVTKSALINWLSEQYTEEYMVKKVYAHDSVITLDKLPDLKNYPIYE

SEQ ID NO: 154 - protein, 1414 aa, Anaerocellum thermophilum
MRVKTKMGKKWLSILCTVVFLLNILFIANVTNLPKVGAATSNDGVVKIDTSTLIGTNHAHCWYRDKLETALRGIRSWGMNSVRVVLSNGYRWTKIPASEVANIISLSRSLGFRAIVLEVHDTTGYGEDGAACSLAQAVEYWKEIKSVLEGNEDFVIINIGNEPYGNNNYQNWINDTKNAIKALRDAGFKHTIMVDAPNWGQDWSNTMRDNAQSIMEADPLRNLVFSIHMYGVYNTASKVEEYIKSFVEKGLPLVIGEFGHQHTDGDPDEEAIVRYAKQYKIGLFSWSWCGNSSYVGYLDMVNNWDPNNPTPWGQWYKTNAIGASSVPTSTPTPTPTATPTATPTPTLTPTPTPTPTPTSTPTATPTATPTPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTPTPTPTPTATPTPTPTPTPTPTATPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTPTPTPTPTATPTPTPTPTPTPTATPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTSYGENVKVTAYIDGVLVWGQEPSGATPTPTATPAPTVTPTATPAPTPTPTPTVTATPTPTPTPVQTVIPMPTVTPNPTSTPSILDDTNDDWLYVSGNKIVDKDGKPVWLTGINWFGYNTGTNVFDGVWSCNLKDTLAEIANRGFNLLRIPISAEIILNWSQGIYPKPNINYYVNPELEGKNSLEVFDIVVQICKEVGLKIMLDIHSIKTDAMGHIYPVWYDDKFTPEDFYKACEWITNRYKNDDTIIAFDLKNEPHGKPWQDTTFAKWDNSTDINNWKYAAETCAKRILNINPNLLIVIEGIEAYPKDDVTWTSKSYSDYYSTWWGGNLRGVKKYPINLGKYQNKVVYSPHDYGPSVYQQPWFYPGFTKESLLQDCWRPNWAYIMEENIAPLLIGEWGGYLDGADNEKWMRYLRDYIIENHIHHTFWCFNANSGDTGGMVGYDFTTWDEKKYSFLKPALWQDSQGRFVGLDHKRPLGTNGKNINITIYYNNNEPAPVPAAK

SEQ ID NO: 155 - protein, 882 aa, Scheffersomyces stipitis
MLLQAFLFLLAGFAAKISATFQQPSIVESTFKDWKYREYKTSEWKLSRTDAETTEIHADLLANKEIPDPFMDTNERDVQWIGEKDWEYGNEFFVSANAKPLSVHELVFEGLDTFATVYLNNEEILTTDNMFREYRVDVTKYLNFDGANNLRILFKSALHTARALERKHGKLFCFNGESSRVQVRKAQYHFGWDWGPVLITCGPYKPVKLVSYDSYIKDVYFKVDVNKELKASIDIQSDIFTGSSSSTLEIEVKSPSGSVIQTFSSKVDKSDIFSHKFAVEEPDLWYPLGHGKQSLYEFKISLENQVIVKKVGLRKVELVQESFAEQEGSSFYFKVNNIPIYCAGSNWIPAHSMQTLLVDSDYKQLLQLMIDGHQNMVRIWGGGYYEQDIFYDECDRMGILVWQDFMFACGQYPGYPEYLESVSEEAKHQLKRLRNHCSLAIYAGNNEDYQVAEQFNLEWDPTDNSGDYSKSNFPARTLYETIFPKLVSEFCPEIPYHPGSPWGGNGTADPTVGDLHQWNVWHGSQEKYQEWHKLGGRFISEFGMEALPNRKTFEACITDPDELYPQSESVDHHNKADGFERRLALYVIENIKVQGLDFDSWIYATQLMQAECLGYAYRYWRREWRGDGKRYTGGAIVWQINDCWPVTSWAIVDFYKRPKLAYYSVKRESRPIGLGMFRNEKKHTHEQAKPHSTAGPPHDYSQVDYNVDIWGVNSNTVDQPAVLKVDIYNVTSGKKLESLPDQDVVLKSNSSTEFVSAHPIANDQPIVVYSRFVSKEDGSIIASAGDWPQPLKYLKFPGREVKFEVSNGSIKLSSNKPVKGVEILVERDVFLQDNGFDLFPGDEKVVIAEDLKTTDKVTVRYYQQQDDDDKGGSPPSHHHHHH

SEQ ID NO: 156 - protein, 949 aa, Aspergillus clavatus
MRIREQTILALLSPGLPPVTGQHVLDLSEPGWTVSSKALNRTVPGRLPSQVHLDLFEAGVIATMGSMILTFAGLRMPTGRTPATLLLGCELTDHESTWLVFDGLDTFTTITFCDQIIGSTYNQFRQYHFDVSQVLKECKQEGPVLSINFGSAPNIANAIANGPSAEEWPAGVQITNEYPNRWYIRKEQSDFGWDWGPAFAPAGPWKPAYIVQNKNPDRLYVLNTDLDIYRRGQINHLPPDQSQSWVVNASIDVLGSVPQWPSMSVEIKDAYSGVVLSSGLLENVTVSGNSVTGVTVVDGRTPKLWWPNGMGDQSLYNVTIAVHNHRNQVVAEVMKRTGFRTIFLNQRNITEEQLAQGVAPGANWHFEINGREFYAKGSNIIPPDAFWPRVTPSRMERLFDAVTAGNQNMLRVWASGAYLHDFIYDLADEKGILLWSEFQFSDALYPVDDAFLENVAAEVVYNVRRVNHHPSLALWAGGNEIESLMLPMVRRADHKGYAKYVGEYEKLYISLILPLVYENTRSITYSPSSTTEGYLHVNLSAPVPMTERYSNTTPGSYYGDTDYYNYDTSVSFNYHKYPVGRFANEFGFHSMPSLQTWQQAVDPKDLYFNSSVVVLRNHHYTAGGLFTDNYQNSSRGMGEMTMGVESYYPIPSKSDPVANFSAWCHATQLFQADMYKAQIQFYRRGSGMPERQLGSLYWQLEDTWQAPTWAGIEYDGRWKMLHYVARDIYEPIIVSPFWNYTTGDLEVYVTSDLWEPAQGTVNLTWVDLSGKSIAGNAGTPESIPFSVGALNATDVYSANVADLSPPDLTDSILILSLAGEGYLPNARTRSEFRHENQFTPVFPKDLALRDPKLELAYNPDTRTFTVEATAGVSLYTWLDYPAGVVGYFEQNGFVLLPGMKKEIGFVVQEGSVDEDWMRSVTVTSLWDQKVREDDDDKGGSPPSHHHHHH

SEQ ID NO: 157 - protein, 878 aa, Debaryomyces hansenii
MLLQAFLFLLAGFAAKISATMTSQTTYNTLSNWSYKRANKDSTKWQPCSKKTNGNQIHTDLLNNGEIPDPFIDRNEKDLQWIGEEDWEYKTTFKVDSNKKHELVFEGLDTFATIYVNDKQVLTTDNMFRTYTLDVTNCSQESNELRIVFKSALKVSRALEEKHGKFTCFNGETSRVHARKAQYHYGWDWGPLLLTCGPWKPIKLVTYSTAKINDFYVKQSVDENLQAELSFEVEVESISDDCQLSIEIFSSAGKLIRTIKESANKSYTFDPIKLEDPELWYPKGYGKQPLYKFVAKLHQTDQIIDSVVSEVGVRRARLVQEPVKGQDGSSFYFEVNNIPIFCNGSNWIPSHSFSCSLIDDDYVDLIRLVDEGNQNMIRVWGGGFYENDILYKQCDKLGILIWQDFMFGCAIYPGYKEFIDNVTHEVIDQLKRLRNYCSIVFYVGNNEDYQVAEDLYKKNTFTDEEFPAKKLYERILPDMVSKLTSGVGYQFGSPISPGQGVPTTDVTVGDIHQWNVWHGTQEKYQDWGKLVGRFVSEFGMLAFPDIKTLKDCITDEKQLYPQSETMDHHNKSIGFERRLALYVMENFSVSSMALADWIYITQLMQSDCLAYAYRNWKREWGSKNERKCGGALVWQINDCWPVTSWAIIDFYHRPKLAYYAIKRECQPLMLGIYRTETRLRQPGEPDLEKQAPLHDYSPREYTIDVWGVNSTLQDFSGTLEVELYHCETGELVSNLEKSKITLAPNQTTELVTKSKIDSNKLVVHAKLVDSASKLVSNTSDWPQPLKYIIWPKDTKLDVSIPENGTIKLSTNKPVKGIALNIEGDYYLHDNSIDLLPNNDHYIKVDNLQSDDVAKISVNYLKDDDDKGGSPPSHHHHHH

SEQ ID NO: 158 - protein, 878 aa, Aspergillus nidulans
MLLQAFLFLLAGFAAKISAGAFTQHVLSEGWSFKDSGDQSPDAWLSVPTVPSVVHQDLQANGKLDDPFIGLNELSARWVNEKSWTYRNVFQKPTVPAGSSIFLVFDGLDTFAKVKLDGQVILESDNMFLAHRVDITKALDVEGEHTLEIDFDCALLRARELRKQHPDHKWVGFNGDTARLSVRKAQYHWGWDWGPVLMTAGIWKEVRLEVYSAKISDLWTEVHLAEDHSKARITAAAEVETQGTGNSYKATFTLSLQGQQIGKEVATLDGNVAKTTFDVQEPSLWWPNGYGDQTLYEISVSLEKEEEQAHQVSKKFGIRTAEVIQRPDKHGKSFFFRINGVDIFCGGACWIPADSLLTNITPDRYRKWIELMAVGHQVMIRVWGGGIYEDESFYQACDEVGVMVWQDFMFGCGNYPTWPEILESIEKEAEYNLRRLRHHPSIVIWVGNNEDYQVQEQQGLTYNYADKDPESWLKTDFPARYIYEHLLPKAVQKIIPSAYYHPGSPWGDGKITSDPTVGDMHQWNVWHGTQEKYQIFDTLGGRFNSEFGMEAFPHMSTIDHFVTNEADKYPQSHVLDFHNKADGHERRIATYLVENLRTATDLETYIYLTQVVQAETMMFGYRGWRRQWGDERHCGGALLWQLNDCWPTISWAIVDYFLRPKPAFYAVSRVLKPLAIGVRREHHDWSVSHAQPPKTSKYELWVVSSLLKEVIGKVELRFISIKTGLAIHESIVRENVTIVPNGTTNILDGVIDHAVDEPHVLAARLWVDGELVARDVDWPQPFKYLDLSDRGLEITRISKTESEQVLELSARKPVKCLVFEERDNVRVSDSAIDIVPGDEQFVTIKGLKRSDAPLKYKFLGQDDDDKGGSPPSHHHHHH

SEQ ID NO: 159 - protein, 875 aa, Pyrenophora tritici-repentis
MLLQAFLFLLAGFAAKISAAKSQSLSCYRLSEGWSFKQSDDATKNAWMPVKKVPTNVHLDLIEAGKIPDPFLGFNELHAEWVADKAWTYKVELPQVQEANEGTTHVLAFDGLDTFATVRINGETVLESDNMFIPHRLDVTKKLRLGEKNILEIGFASARLEAIKIKEMYPEHKWVGFNGDMSRLAVRKAQYHWGWDWGPILNTCGPWREVRLETYQARFEDLRVDYKLESGLKSVHGTVSATVQGVSADSVSFDVFDGDKQVFKETAKISNGVATVDFHVNNPKLWYPHGYGEQPLYTVTATLFANDVKLHQTSRRTGFRKGELIQEPDAIGKSFYFRVNGVDVFCGGSDWIPADSFTPRVTEDQYRRWLELMVDGYQIMIRIWGGGIWEEDVFYDICDELGVLVWQDFMFGCGNYPAFPDILRSIKEECTANVTRLRHHPSIIIYAGNNEDYQVQETYGLTYDYDDKDPESWLKTDFPARYIYEKLLPDVVAAESPHVPYHPGSPWGDGLKTSNPTVGDMHQWNVWHGTQEKYQIFDTLGGRFNSEFGMEAFPHIDTVRYWCTDPTQLYPQSHMIDFHNKADGHERRIATYLVENFRTKTDLESFIHLTQLSQAEALMFGYRGWRRQWGQNRHCGGALVWQLNDCWPVTSWSIVDYFQRKKPAYYAMRRVLAPIAVAVKRAHFDWSVVHARVPATSDYEVWVANQKLDEVVATVELRYISVKSGKEIKEKIVKKDIRLVPNGTTDVLSGTIDNRNEQPHVLAVRIWVDGEIVSRDVDWPQPLKYLDFDDRGVEVIPRGETIVVRAQKPTKGLVFEERSGVLVHDSAIDLVPGDEQIIKVRGLGPQDKPLRWTYLGKDDDDDKGGSPPSHHHHHH

SEQ ID NO: 160 - protein, 483 aa, Aspergillus fumigatus
MPSKKPLSNSTAFSLSKNSQITFSVLGIMHPLPSVALLSAIGAVAAQVGPWGQCGGRSYTGETSCVSGWSCVLFNEWYSQCQPATTTSTSSVSATAAPSSTSSSKESVPSATTSKKPVPTGSSSFVKADGLKFNIDGETKYFAGTNAYWLPFLTNDADVDSVMDNLQKAGLKILRTWGFNDVNSKPSSGTVYFQLHDPSTGTTTINTGADGLQRLDYVVSAAEKRGIKLLIPLVNNWDDYGGMNAYVKAYGGSKTEWYTNSKIQSVYQAYIKAVVSRYRDSPAIMAWELSNEARCQGCSTDVIYNWTAKTSAYIKSLDPNHMVATGDEGMGVTVDSDGSYPYSTYEGSDFAKNLAAPDIDFGVFHLYTEDWGIKDNSWGNGWVTSHAKVCKAAGKPCLFEEYGLKDDHCSASLTWQKTSVSSGMAADLFWQYGQTLSTGPSPNDHFTIYYGTSDWQCGVADHLSTLDDDDKGGSPPSHHHHHH

SEQ ID NO: 161 - protein, 400 aa, Aspergillus niger
MKLSNALLTLASLALANVSTALPKASPAPSTSSSAASTSFASTSGLQFTIDGETGYFAGTNSYWIGFLTDNADVDLVMGHLKSSGLKILRVWGFNDVTSQPSSGTVWYQLHQDGKSTINTGADGLQRLDYVVSSAEQHDIKLIINFVNYWTDYGGMSAYVSAYGGSGETDFYTSDTMQSAYQTYIKTVVERYSNSSAVFAWELANEPRCPSCDTSVLYNWIEKTSKFIKGLDADRMVCIGDEGFGLNIDSDGSYPYQFSEGLNFTMNLDIDTIDFGTLHLYPDSWGTSDDWGNGWITAHGAACKAAGKPCLLEEYGVTSNHCSVEGAWQKTALSTTGVGADLFWQYGDDLSTGKSPDDGNTIYYGTSDYQCLVTDHVAAIGSADDDDKGGSPPSHHHHHH

SEQ ID NO: 162 - protein, 385 aa, Chaetomium globosum
MKAIFTLGLSLLSAAQALPSARAAASSTVDGTRFSIDGKTGYFAGTNSYWIGFLTNNQDIDTTLDHIATSGLKILRVWGFNDVNTKPGAGTVWFQLLSSSGSQINTGTDGLQRLDYVVQSAEKRGVKLIINFVNFWDDYGGMNAYVKAFGGSKESWYTNANAQAQYKKYIEAVVSRYSKSDAVFAWELANEPRCKGCSTDVIYKWATDISAYIRSLDSSHMITLGDEGFGLPGDTTYPYQYTEGTDFVKNLGIKDLDFGTFHMYPDSWGVPYSFGEGWIKSHAAACKAAGKPCLLEEYGANASCDIQKPWQQSSLALAADGMSGDLFWQWGDQLSSGQTHNDGNTVYYGSELATCLVTDHVKAIEAASDDDDKGGSPPSHHHHHH

SEQ ID NO: 163 - protein, 404 aa, Aspergillus nidulans
MRLIHAVLGLLAGAAPALVAASPAAPIGNGRDQVSKAVGRHFEIDGKVQYFAGTNCWWLGNLLNDFEVELAVSQIAETGYKVVRTWGFFGVNDPSNPGQPVYYQVLNESLYEGGLGINYGSNGIRRLDTVVSLAERYDIQLVLTFMNNWNDFGGINIYSNAFGSNATTWYTDKKSQRAYREYIKFIVNRYKGSSAIFAWELGNEPRCKGCDPSVIYNWAKSVSAYIKKLDKKHMVALGDEGWLCPPEGDGTYAYDCSEGVDFVKNLEIETLDYGTFHLYPESWGYNYSWGSEWVLQHDAIGKRFNKPVVFEEYGTPLNHTQLERPWQLTTVKETQVAADFIWQFGTVLPVEGTEWGDVNSIYYGTEEYEVLAVQHAWEMARKKVPRHDDDDKGGSPPSHHHHHH

SEQ ID NO: 164 - protein, 529 aa, Arabidopsis thaliana
MRHLSSPPWPLLLLLLLSSFTSGESSLSAEKNKLHTGGLSRQSFPKGFVFGTATSAYQVEGETHQDGRGPSIWDAFVKIPGKIAKNATAEITVDQYHRYKEDVDLMKKLNFDAYRFSISWSRIFPEGSGKVNWKGVAYYNRLIDYMVQKGITPYANLYHYDLPLALENKYKGLLGRQVVKDFADYAEFCYKTFGDRVKNWMTFNEPRVVAALGYDNGIFAPGRCSKAFGNCTEGNSATEPYIVTHHLILAHAAAVQRYRKYYQAKQKGRVGILLDFVWYEPLTRSKADNLAAQRARDFHIGWFIHPLVYGEYPKTMQNIVKERLPKFTEKEVKMVKGSIDFVGINQYTTYYMSEPHPTTKPKDLGYQQDWNVEFGFAKLGKPIGPRAYSSWLYNVPWGMYKALMYMKERYGNPTMILSENGMDDPGNVTLAQGLHDTTRIKYYKDYLTNLKKARDDGANVVGYFAWSLLDNFEWLSGYTSRFGIVYVDYKTLKRYPKMSAQWFKQLLKRNNKDDDDKGGSPPSHHHHHH

SEQ ID NO: 165 - protein, 526 aa, Hordeum vulgare
MRSSPVLLLVIALVAAAHLAPLECDGPNPNPEIGNTGGLSRQGFPAGFVFGTAASAYQVEGMARQGGRGPCIWDAFVAIPGMIAGNGTADVTVDEYHRYKEDVGIMKNMGFDAYRFSIIWSRIFPDGTGKVNQEGVDYYNRLIDYMLQQGITPYANLYHYDLPLALHQQYLGWLSPKIVGAFADYAEFCFKVFGDRVKNWFTFNEPRVVAALGYDNGFHAPGRCSKCPAGGDSRTEPYIVTHNIILSHAAAVQRYREKYQPHQKGRIGILLDFVWYEPHSDSNADQAAAQRARDFHIGWFLDPITNGRYPSSMLKIVGNRLPGFSADESRMVKGSIDYVGINQYTSYYMKDPGAWNQTPVSYQDDWHVGFVYERNGVPIGPRANSDWLYIVPWGMNKAVTYVKERYGNPTMILSENGMDQPGNVSIADGVHDTVRIRYYRDYITELKKAIDNGARVAGYFAWSLLDNFEWRLGYTARFGIVYVDFNTLKRYPKDSALWFKNMLSEKKRSDDDDKGGSPPSHHHHHH

SEQ ID NO: 166 - protein, 518 aa, Oncidium Gower Ramsey
MNPFFLLIFLFPRTSQPVAAAPVAGSRTDAGGLNRDNFPVGFTFGTAASAYQVEGMALKDGRGPSIWDEFIKIPGEIKNNATAAVTVDEYHRYKVDIDIMKNMNFDAYRFSISWSRIFPNGSGKVNWKGVAYYNRLIDYMLQQGITPFANLYHYDLPEALEKSYNGLLSRNVVKDYADYAEFCFKTFGDRVKNWFTFNEPRVVAALGYDNGIFAPGRCTGCTAGGNSTTEPYIVAHNLILSHAAAVKRYRDKYHVSQKGRIGILLDFVWYEPLTNSTDDEAAAQRARDFHIGWFLHPIIYGEYPKSVQDIVKERLPTFTAEEISIVKGSVDYLGVNQYTSYYMFDPHLPTQTSTGYQTDWNVGFAYERDGVPIGPRANSDWLYIVPWGMYKAVTYVKENYQNPTIILSENGMDDPGNVSLTVGVHDATRLNYYKSYISELKRAIDDGATVIGYFAWSLLDNFEWKLGYTSRFGIVYVDFKTLKRYPKMSAYWFKDVLQKKKDDDDKGGSPPSHHHHHH

SEQ ID NO: 167 - protein, 529 aa, Zea Mays
MQSSVKLAVLALLLAAAAHHGLLPLPTARCYWLNPEIYDAGGLSRRAFPDGFVFGTAASAYQVEGMAKHGGRGPSIWDAFIEVPGTIPNNATADVTVDEYHRYKEDVNIMKNMGFDAYRFSISWSRIFPDGTGKVNQEGVDYYNRLIDYMLQQGIAPYANLYHYDLPLALHEQYLGWLSPKIVEAFADYAEFCFHAFGDRVKNWFTFNEPRCVAALGYDNGLHAPGRCSGCPAGGNSTTEPYLVAHHLILSHAAAVRRYRDKYQLHQKGKIGILLDFVWYEPFSDSNADQAAAQRARDFHLGWFLDPIVHGRYPYSMQEIAKDRLPLFSDEEARMVKGSIDYVGINHYTSFYMKDPGTWNLTPVSYQDDWHVGFVYERNGVPIGAHANSYWLYIVPWGINKAVSYVKETYKNPTMILAENGMDQPGDVSITQGVHDTVRIRYYRDYITELKKAIDDGARVIGYFAWSLLDNFEWRLGYTSRFGLVYVDYKTLKRYPKDSAFWFKHMLSKKRSDDDDKGGSPPSHHHHHH

SEQ ID NO: 168 - protein, 533 aa, Oryza sativa
MGHRLVVVLLLALLVAGAARAAEQAAGEDGIRGGAGADHQEAAGITGGLSRRSFPAGFVFGTAASAYQVEGMALKDGRGPSIWDAFVKTPGEIANNATADVTVDEYHRYKEDVNIMKSMGFDAYRFSISWSRIFPTGTGKVNWKGVAYYNRLINYMLKIGITPYANLYHYDLPEALEVQYGGLLNRKIVEAFADYAEFCFKTFGDRVKNWMTFNEPRVVAALGYDDGNFAPGRCTKCTAGNSATEPYIVAHHLILSHASAVQRYRHKYQHIQKGKIGILLDFVWYEGLTNSTADQAAAQRSRDFHVGWFLHPIIYGEYPKSLQVIVKERLPKFTADEVHMVKGSIDYVGINQYTAYYVRDQQPNATTLPSYSSDWHAAPIYERDGVPIGPRANSDWLYIVPWGLYKAVTYVKEKYGNPTMFLSENGMDDPGNVTIAQGVHDTTRVAYYRSYITKLKEAIDDGANCIGYFAWSLLDNFEWKLGYTSRFGLVYVDFRTLRRYPKMSAYWFRDLVSSKNDDDDKGGSPPSHHHHHH

SEQ ID NO: 169 - DNA, 3045 bp, Aspergillus oryzae
atgaagctgatttggcctacgtctcttctctttacggccctggtggcagccgaaccttacttgttattttcatctggcacctctgaataccaacttgcgtctaatactactgcaccagctgtttgggtagcgcaaaatgaaccagtaggcgtattaagagctgctcacgatctagccaacgattttggtagagttttgggtgtcaatggtactgttaatgttttcgacactgatatttctgagtcaccaggtaaagcagtaatcatcactggcacagtgggtcaatccacgccaatcgatcaacttgtttccgatgggaaactcgatgtgtccctgatagaaggaaagtgggaaagttatgtgtctcgtatcgttgaaaatccatttccaaacgtgacatggtcactcgttgtagctggttctgacagaagaggtacaatctacggcttgtacgatataagtgagcaaatgggtgtctctccttggtactggtgggcagacgtccctgttaagaccaaaacaggaatatgggtcgctccagaaggaactttccaaaagtcaccatctgtgaagtatagaggtttcttcatcaatgatgagagtcctgcattgtcaggatgggtggccgagaatttcggtaccaagtttaactctgccttctatagacatatctttgaattatgtttgagactgaagggaaactacctgtggccagctatgtgggggaaaatgttttatgtcgatgatgtcgataatggccaactcgcccatgaatacggtatcattatgggtacaagtcatcatgaaccaatggcacgatcagaacaggagcagaaaacgtacctggatggtgaatggaattggaacgaaaatcaagccaacattacaacatttttccaacaaggcattgatagagccaaacattgggatacaatatggactatgggaatgagaggtgaaggtgacgtggcttctcctacgttgactgctgccgatctggaagagttgattcacgcacaacaaaaattgttggtcgaatcattcaacgcctccgatcctgcaagtattccacaaacatgggtcctatacaaagaggtttcagactactacgccgctggcatggaagtccctgagtcagtcacactactttggacagatgataattcaggtaatctcatcagagttccaatagctaatgaaacatctagagttgcaggtgctggcgtatactaccactttgactacgttggttccccaaggtcttacaaatggataaactcaatacaattggttaagacctgggagcaaatgcatctagcataccaaaaatcagcaagacaaatctggattgcaaacgtgggggacatcaaaggtcttgaagtcccactcactcactttatggacatggcctatgacatggataggtttacgtctacagactcaacaacaaaatggttgaagcgttgggcagcgagagagtttaacgaaaggattgccgatagaacagctgatatcttaaaccactatggcacattagttgccagacgtaagtacgagctattgtcacaactgccattcgctttctctactatctactatgacgaagcagaggcgaatcttgctcaatgggagagtttacttgcccaaacacaatcagtctattcaagtttagatcaagctaccagaaccccatttttcgaaatgtttttacatcctgtcctagcgggtaaaactgtagtggatctgtatacaaaaacagcttttaatgcactctaccatcaacaaggtagaatatctacaaacagattagctcagaaggttcatgacttgtttacagaggacagtgccattacggaaagataccacggggtgaaaggagggaaatggaggcctgtcatggatcaggttcacatcggctactcaagctgggatgatccagttgataatacaaatgtaatgccagctctatcttacatcgccgctccacaaggagcgggtggaataggcattgcagttcagggttcagcagcttcctacccagagcaaaagacactaagacttttgtctatggacccttacatgccacctagtgaatccagatacattgatatctttgcaaggaaaaatacaacggtgacgtattcaattagctccaatactagctacgtgacagtatctaacgcttcaggcagtgtctctgcaagcagcaatatcagcgatgttagatccaccatcactgtagactgggcatccgcagaacctggactttcccataccgaactccaagtgagagccggagatggcttcactgctgctctagtacttccagtcaataatacttttgtcccaactaactttactggttttgtcgagtccaatggagttatctccatcgaagcgtcacattatacatccgctgaaacaaaatctaatgtatcatacgttgaaatccctcattatggtagaacattatcagcagttatgccttggccagttactatggggacacagcatcctaacactggaccagctttaagatactcattgtacactactacagcttctccaagcgctaggttgattatctccttgggagcatcacataaccatgatccaactagattgattaagttcgcttactcattagacgggtctgttcctgttactgttcgaccagtctcaactgtaccaccatacaaggaaggtcaggcttggcagcaggccgttatagaaaacggttggacctctgttattgaactaccaggtgaagtgggtactggagagcatgaattatctttatggttgcttgaacctggagttgtattacaaaagattgttttggacatgggagggtatcaagattctgcattagggagtcctgaacgtgctgtggttaccgaagctgacgtattgagagcggaagtcgttgaggaaggcagcgatatctcaccattgtctagagtctggagattgccatcttctcatgacttagatgatgatgacaaaggtggttctcctccttctcatcatcaccaccaccactaa

SEQ ID NO: 170 - DNA, 2547 bp, Trichoderma reesei
atggtcatcagatctttgttgttgttgttattggctgctatagttccagtttttgctgaatctggtattgatgcttggttgagatatgctagattgccatcttctgctactagaggtcatttgacatcttttccagatagaatcgttgttttgaatgcttctaaaaatggtccattggcttcagcttcatctgaattgcataagggtatcaaaggtattttgggtttggatttggatgtttcttctagaggtggtaaacattgctctactcaaaagtctatcgttatttctactttggatacttatcaatctgcttgtggtaaattgtctccaaagttgaacttgaaagaagatggttattggttgtctacaaaaggtggttctgttcaaattattggtcaaaacgaaagaggtgcattatacggagcttttcaatacttgtcttatttgggtcaaggtgatttttctggtaaagcttttgcttctaatccatctgctccagttagatggtctaatcaatgggataatttgaatgctgctactgctgctcatggttctattgaaagaggttacggaggtccatctattttttttgaaaacggtttgatcaaagaagatttgtctagagttccattatatggtagattattggcttctgttggtttgaatggtatcgttatcaacaatgttaatgctgatgctaatttgttgaacgaaactaacttgcaaggtttgaaaagaattgctgatttgtttagaccatggggtgttaatgttggtatttctttgaattttgcttctccacaagttttgggtgatttgtctacttttgatccattggatgattctgttattaagtggtggactgataagactgatagaatctatcaattggttccagatttggctggttatttggttaaggctaattctgaaggtcaaccaggtccattgacttataatagaactttggctgaaggtgcaaatttgtttgctaaagctgttcaaccacatggtggtatagttgtttttagagcctttgtttacgatcaattgaacgaaacagattggaaagctgatagagctaatgctgctgttgatttttttaagtccttggatggtcaatttgatgataacgttttggttcaaatcaaatacggtccaattgattttcaagttagagaaccagcttctccattatttgctaatttgccaaaaactgctgtttctatcgaattggaagttactcaagaatacttgggtcaacaatctcatttggtttatttgccaccattgtggcaaactgttttgggttttgatatgagatacaacaacagacaatcttacgttagagatattatttctggtgaagtttttggtcataagttgggtggttatgctggtgttattaacgttggtatggatgatacttggttgggttctcatttggctatgtctaatatgtttgcttatggtagattggcttggaatccaagagctgattctagagatatagttgaagaatggactagattgacttttggtttggatagagatgttgtttctactattgctgatatgtctttgaaatcttggccagcttatgaaggttattctggtaatttgggtattcaaaccttgactgatatcttgtatactcattatggtgctaatccagcttctcaagataacaatggttggggtcaatggactagagctgattcaaaaactattggtatggatagaactgtttctaatggtactggtaatgctggtcaatatccaaaagaagttgctgctagatttgaacatactcaaactactccagatgatttgatgttgtggtttcatcatgttccatacacttttagattgcattctggtaagtctgttattcaacatttttacgatgctcattatactggtgctgctactgttcagagatttccagctgcttggaagtccctaaagtctaagattgatactgaaagatacaatgctgtcttgtacaaattgcaatatcaaactggtcattctttggtttggagagatgctattactgaattttacagaaacttgtcctctattccagatcaattgaatagagttagaaaccatccacatagaattgaagctgaagatatggatttgtctggttttactgttgttaatgtttctccaactgaatgtgcttctaagtacaaagctattgctactaatggtacaggtacagctactactagattgaatgttccatctggtaagtatactgttgctgttaattactacgatgttattaacggtactgcttcttatgatgttttgttgaacggtaaatctttgggtaaatggaaaggtgattctgaaactcatttgggtcatgatttttctacattcttggattgtcattctgctattagaattactttcgaaggtgttagaatttctagaggtgataagttgactattagaggtacaggtaatgctcaagaacaagctgctattgattacgtttctattttgccacaaggtgttgttgattgataa

SEQ ID NO: 171 - DNA, 2529 bp, Aspergillus niger
atgagaggtttgaatttgttccaattgattttggctttgttgttgtctatggttgctgctgaagatggttatgatggttggttgagatatgctccagtttcttgtgatttgagatgtagacaagctttgccatctcatgttgttttgttgaactctacaaaaggttctccaattgaaactgctggtagagaattgaaagctggtttccaatctattttgtctactaatttgacttctagaccatttcaatgtaactcttctacctctattttggttgctactttggatgagtatagacaaagatgcagagatattaacgttccagaattggatccagatggtttttggttgcaatctgaaggtgatactgttagaattttgggtaaagatgctagaggtgcattatatggtgcttatgaatatttggctatggttgctcaaagaaatttttctagagttgcttatgctacttctccacatgctccaattagatgggttaatcaatgggataatatggatggttctattgaaagaggttacggaggagcttctattttttttaaggatggtactgttgttgaagatatggctcctgttgaacaatatgctagattattggcctctattagaatcaatgctatcgttgttaacaatgttaatgctaacgctactttgttgttgccagaaaacatgaagggtttgggtagaattgctgatgcttgtagaccatatggtgttcaaattggtatttctttgaattttgcttctccagaagatttgggaggtttgaatacttatgatccattggatccaggtgttattgcttggtggcaaaacattactgattccttgtatacttatgttccagatatggctggttatttggttaaggctgattctgaaggtcaaccaggtccagatacttataatagaaccttgtctcaaggtgctaatttgtttgctagagctttacaaccatatggtggtgttttgatgtatagagctttcgtttacgatgataacttgaatgaatctgattggaaagctgatagagctaaagctgctgttgaatactttaaagatttggacggtcaatttgaagaaaacgttgtcattcaaatcaaatacggtccaatcgattttcaagttagagaacctacttctccattatttgctaacttgtaccatacaaacactgctattgaattggaagtttcccaagaatatttgggtcaacaatgtcatttggtttatttgccaccattgtggaaaactgttttggatttcgatttgagagttgatcataagccatctatggttagagatattatttctggtcaaagattcaatagaactttgggtggttgggctgctgttgttaatgttggtactaatagaacttggttgggttctcatttggctatgtctaacttgtatgcttatggtagattggcttggtcaccaactgatgaatctgaacaaattttggaagattggactagattgacttttggtcaaaaccatcatgttattaacaccatttctgatatgtctatgacttcttggccagcttacgaaaattatactggtaacttgggtattcaaactttgactgatatcttgtatactcattatggtccaaatccagctactcaagataacaatggttggggtcaatggactagagctgatcatgattctgttggtatggatagaactattagaaatggtactggttatactggtcaatatccagaagaagttgctagagtttacgaatctttggaatctactccagatgatttggttttgtggtttcatcatgttccatggactcatagattgcattctggtgttactgttattcaacatttctacaatgctcattatgctggtgctgaagctgctcatggttttgttagacaatgggaatctttagaaggtttgatcgatagagaaagatatgaagctatgagatctagattggtttatcaagctggtcattctatagtttggagagatgctattaacaatttctactacaacatgactggtattccagatgttgctggtagagttggtcatcatccttggagaattgaagctgaatctatgagattggatggttatcaaacttatactgtttctccatttgaagctgcttctaacactactgctattattactacttctaactctactactggtactgctagaacttctattaaggctccatctggtgtttatgatattggtgttaactattatgacttgtatggtggtcaatctaaatggactttgtctgttggtgataaggttgttggtcaatggttgggtgatatggaacataattctttgggtcatactccatctatctatttggatggtcattctgctactagaattacttttcatggtgttggtattagacaaggtgatcaattgaaaatcgttggtgaagctaatggtgttgaaccagctccattggattatatcgttttgttgccaccaggtttggttgattgataa

SEQ ID NO: 172 - DNA, 2517 bp, Talaromyces emersonii
atgatgaggaggctactattattattgtccgctggtttggttgctgctgaaaatggtttggatggttggttgagatatgctccattgccaggtgcttctagatacttgcatgatttgccatcttctatagttgctttgaatgcttctgaaacttctccagttttggttgctggtactgaattgagaagaggtttacaaggtattttcggtaaacatgtttctatttcccatcaagattgcaatgcttcatcttctatcgttgttggtactgttgatgaatactctaaattgtgtggttctactgctgctttgccagaattggatcaagatggttttttgttgaacactaagggtaatactgttcaaatttctgctgttacttctgctgttagatctatggctggtgcttttgaatatttgtctatgttggctcaaggtaatttttctcaagttgcttatgcttctaatccaagagcaccaattagatgggttaatcaatgggataatttggatggttctattgaaagaggttacggaggcgcttctattttttttgaaaacggttctgttgtttctaatttgactagagctgctcaatatgctagattattggcttctattggtgttaatgctgttgttgttaacaatgttaatgctaacgcttctattttgactgctgataacattgatggtttgggtagaattgctgatgtttttagaccatatggtgttcaattggctatttctttgaattttgcttccccaactattattggtggtttgaatacttttgatccattggatccatctgttattgcttggtggactaatgttactgataatttcactgctcatccagatatggctggttatccagttaaggctgattctgaaggtcaaccaggtccattgacttataatagaaccttggctaaagaaccaccattttttgctaaagttttacaaccacatggtggtatggttatgtttagagctttggtctacaatcaattgaatgaatctgattggaaagctgatagagctaaagctgctgttgatttttttcaaggtttggacggtcaatttgatgataatgttgtcgttcaaatcaaatatggtccaatcgattttcaagttagagaacctactccaccattatttgctcatttgagaaatacttctaccgctattgaattggaagttacccaagaatatttgggtcaacaatgtcatttggtttatttgccaccattattggaagatagaccatctgctttgacatctggtgttaatcaagaatctagaagattggttagaaacattattactggtcaaagattcaatagaactttgggtggtgctgctgctgttgttaatgttggtactaataccacttggttgggttctcatttggctatgtctaacttgtatgcttatggtagattggcttgggatccagcttctgatgctgaaagagttttacaagattggattagattgacttttggtcaagatagatctgttattgataccattacccaaatgtctatggaatcttggccagcttacgaaaattattctggtaacttgggtattcaaactttgactgatatcttgtacactcattttggtccaaatccagcttctcaagataacaatggttggggtcaatggactagagctgatcatacaactattggtatggatagaactgtttggaatggtactggttatactggtcaatatccaccagaagttgctgctatgtacgaaaacattgatacaactccagatgatttgttgttgtggtttcatcatgttaattacacccatagattgcattctggtaagactgttattcaacatttttacgatgctcattatagaggtgctgaaactgctcaaacttttttgactatgtgggaagctttgaaaggtaaaattgactctgaaagatacaatgatgttcatttcagattgacttatcaagctggtcattctatagtttggagagatgctattactaatttctacttcaacttgtctggtattccagatgaagctggtagagttgatcatcatccttggagagttgaagctgaatctatgactttgtctggttgtaaaacttatgctgtttctccatttgaaactgcttttaacactactgctatcgttacttctactaattctactgttggtactgctactacaaaattggattacagattgcatgttagaccaggtagagaattattgagacatgttagaggtcaagttcatttggctggtgttttaaatgatagaaagtctgctaatggttctggtaacaaagaagaacattttggtcatactccatctatctatttggatggtcattctgctactagaattacttttagaggtgttaagattggtaaaggtgatgaattgaaaatcgttggtactccagatggtgttgaaccagctccattggattatgttgctgttttgccaggtggtgttgttgattgataa

SEQ ID NO: 173 - DNA, 2877 bp, Chaetomium globosum
atggccaagaagttgttcattaccgctgccttagctgccgcagtgcttgctgcaccattcaaaaacggtgatgttacttctcactaccaaatactaggctctggtttaacaaacaacagatcatcagcctccatcggtaacccagttaatagacactacggtcctctcactaaaaagaaaagattgggcaacagttcaggattaggtaaagtaagacatcacgggaaagttacacctgcttctcctttggatgcggctctaagtttgacaacaatgagaagcctcctgttattagccgccataggctttgctgctgctgaagatggactgtccggatggctccgttatgctagaattaagggtgcaaatggttatcataacaagttaccaagcgctattgtgactcttaacgctactgaaggctctccagtgtacacagcgggtcaagagttgtctgatggtatttcaggaatctttggtaaggacttagactttgccaccacatcttctagaaagccaccaagagatacaactgccacagtaggtactgtctctgcttacattgattctaatccaggtgccgcagacagattgcctgagctggtcgatgatggtttttacctttctgtgtccaaaggtaacgttttgattctaggtcagaatgaaagaggagcactatatggagcatttcattacttatcacttctagcacaaggaaatgcctcagattttactttaacatcaaatccagaagccccaataagatgggtcaatcaatgggataatatgcaagatggcgggactcacgggtcagttgaaagagggtacggcggtgactcaatctttttctgggatgggaagatacgagatgatttgacaagagccggtcaatacgcaagattactagcttctatcggcctcaatgctgtagttgttaataacgtcaatgctgatgccaagactttaacacctgaaaatatggacggcttggggcgtattgcggatgcttttaggccttacggtgtccaattggctgtttctcttaatttcgctgcaccagatacattgggaggcctgggaacattcgacccactagacgaaactgttgcaaactggtggaaagacattacagacgaactctataagagaatacctgatatggccggatacctagtgaaagctaactctgaaggacaaccaggtccaatgacttacaataggacactggctgatggggcgaatatgtttgctcacgctctaaagcctcacggtggtataatcctgtttcgtgccttcgtttacgaccacagaactttgaatcagacattagactggaaagcagacagagccaatgctgcaggggactacttccatgacttggatgacaaatttgaagataatgttgttatccaaatcaaatacgggccaatagactttcaggtaagggaaccagtcagtcctttgtttagccatcttgtaaagactccatctgcaattgagctacaaattagtcaagagtacctgggacaacaagctcatctagtatacttagcaccaatgtggaaggaaatccttgactttgacttcagagtcgatggtaaaccatctagaacatcagacatattgaatggtaaaagattcaatcgtaagctgggtggttatgcaggcgtggtgaatgtggggaccaatactacatggttgggttcccatttggctatgtccaacttatacgcttacggtagacttgcatgggattctagtgcaacctccgagggtatgcttgaagagtggatcaaaatgacctttagcgacgataagaaagtaatcgatgttatcactaaactctccatgcaatcttggccagcatacgaagattacacgggcaacttaggtatacagacattgactgatattctcctagggcattatggcccaaacccagcctctcaagatggtaatccttggggccaatggacgagagccgatggcgattcaattggtatggacagaactgtatggaatggtactggattcgcaggtcaatacccacctcaaatcgcagcgatgtacgaaaaggttgaaaccacccctgacaatttgttattgtggtttcatcatgttccatatacacaagtactgaaatcaggtaagaccgttatccagcatttttacgatgcacattatgagggatcagctgttgctcagaccttccctcaattatgggaaactcttagaggtagaccaggtatcgatgaggaacgtttcgaccatgtcatgtatagacttgtttaccaagcaggacattccttggtttggagagatagtatcaacaccttttatgctaacaaatccggaatagcagatacgaaaggcagagtcggaaaccatccatacaggatcgaagcagaagctatgaaactggtaggttatgaaccttacacagtctcaccatttgaggcagcttctggagctagatgcattgtaacaaaagataatagtactagagcaactgcctcagtcaagttggaagatgtaaaaacaggaaaatatgatgttgctgttaattactacgacatggcgttgggcaattccacttgggaattgtacgtcggctgtgatagaattggaaagtggaaaggcgatcaggagtacatcctcggtcgtgctccttcaccatatattgatggacaaacagcctctagaattacattcaaaggcgtgcatatcaaaaagggcaacacgcttaaaatcgtagggcatccagatggcttagaacctgctccacttgattacgtgtcaatcttaccagaaggaactgttgacgatgatgatgacaaaggtggttctcctccttctcatcatcaccaccaccactaa

SEQ ID NO: 174 - DNA, 2574 bp, Neosartorya fischeri
atgtggagcggcattcctgtattcgcgctcttatcctccatcggcattgcggccgcagaaaatggacttgatggttggctcagatacgcatccgttccttgtaatggaaactgtcaaagagccttgccatcacatatcgtgactctcaattctactaagagtagtcaagtttacgttgccggtcaggagttacaagacggtttgcaccaaatcttaggaaaacacgcctctgtcaaatctacgggctgttctacagattcatcaattgttgtaggaactgtggaggcttatcgtcaagtctgcaacacaggttcacaagctccagagttggatgtagacggattctggctttctataaggggcaagtccgttcaaattgttggtcaaacagagagaggcgcattgtatggggcttacgaatatttgtccatgttagctcagggtaacttttcacaggtcagttatgctacttctccacatgcccctatcagatgggttaatcaatgggataatatggacggttcaatcgaaagaggatacggtgggccatcaatctttttcaaagatggtgtgatccctcaggacctttcaagagtgaagcaatatgcaagattgttggcttcagttagaatcaatggaatcgttgtcaataacgttaatgcaaatgcatcacttttaatgcctagtaacatggatgggctcgctagaattgctgatgttttcaggccatacggtataagagtaggtatatcacttaactttgcatctccatctacattgggaaatttgtctacttacgatccattcgacagttcagtaattgcctggtggggaaacgtgaccgaccaattgtacgctagaatcccagatatggcgggatatctagttaaggctaattctgaaggccaaccaggtccaacaacttacaacagaactctagcagatggtgctaatatgtttgcaagagcattaaaaccacatggcggagtggtgatgtttagagcatttgtttatgatcatcatatatctgaagataattggtacaacgaccgtgctaatgcagctgtcgatttcttcaagccactagacggtaagtttgatgacaatgtagttgttcaaatcaagtacggtccaatcgattttcaagttagagaacctgcttctccactttttgccaatctctacaaaactaatacagcaattgaattacaagttactcaggaatacttgggtcaacagagccacctggtatatttgccaccactttggcaaaccattctgagatttgacttgagagtggatcaaaaaccatcacctgtcagagatatcatttccgggcagagattcgacagacctttaggtggttgggcagcagtagtcaacgtaggaactaatacgacttggcttggatctcatctagctatgtctaacctgtacgcttatgggagacttgcatgggagccaacattagattcagaagatatagttcaagattggattagattgacttttggtttggatagaagagttttagatacgctgacacaaatgtctatggagtcttggccagcttatgaaaattactctgggaatctagggattcaaactttaaccgatattctatacacacattatggacctaaccctgcctctcaagatggtaatggctggggccaatggaccagagccgatcacctgagtattggtatggacagaaccgtcaaaaatggtacaaaattctccggccagtacccagctgaagttgctgccatgtacgaaaacatcgagactactccagataacttaatgttgtggtttcatcatgtgaattacacacaaagactgcattccggcaaaacagttatccaacacttttacgatgcgcattacgacggtgccgaaacggcacaaacattcgtgtccagatgggaaagtctccgtgaacgaattgatgcggaaagatatcaacatgtcttagcgaggttgatataccaagccggtcattctatagtctggagagatgctatcaataacttttaccgaaatctttctggaattgccgatgaaaaggaacgtgtgggctatcatccttggcgagtagaagctgaggatatgcagctggacggttatgtgccttacgctgtctctccattcgaaactgcaagtaactttacagctatcgtcactgcaagcaacggtacaacaggtacagcttctgccacactcgactttaagacaggtacttacgacctagggattaactactacgacatgtacggaggtaagagccattggacagtttacttaaacgatagggtcgtaggccaatggcaaggtaattcagaggacgtgctatcccacactccatcaatatacttggacggacattctgcgacaaggatcaccttcagagatgtaaaaatccataaaggcgatagactaaaaatcgtgggtgaaccagatggcgttgaacctgccccactagattacgctgtagttctccctagaggtatagttgacgatgatgatgacaaaggtggttctcctccttctcatcatcaccaccaccactaa

SEQ ID NO: 175 - DNA, 2565 bp, Talaromyces emersonii
atgatgcgccgtctcttactgcttctgtcggccggcctcgtcgccgctgaaaatggtttagatggctggttacgatacgcccctttacctggcgcttcaagatacctccacgatctgccatcttcaatcgttgctttgaacgcttctgaaacttccccagtcttggtcgccggaactgaattgaggagagggcttcagggtatcttcggtaagcatgtatccatttcacatcaagattgtaatgcatcttcatcaattgttgtaggtactgtagatgagtacagtaagttgtgcggttcaaccgctgcattgcctgaactagatcaagatggatttctattgaacactaaaggcaatacagttcaaatatctgctgttacttctgcagttagatcaatggcaggtgcattcgagtacttgtctatgttggcccaggggaattttagccaagtagcttacgccagtaatcctagagcccctataagatgggtaaaccaatgggacaatctcgatggctcaatcgaaaggggttacggtggtgcttccatctttttcgagaacggaagtgtcgtcagtaatttgactagagctgcccagtacgcaagactgctggcgtcaattggggtgaacgctgtggtagtcaataatgtaaacgcaaacgcttccattttgaccgcagacaacattgacggcttgggcagaatcgccgatgtctttagaccatacggcgtacaattagcgatttctctcaattttgcatcccctactataattggtggcttgaatacatttgacccattagacccatctgtcatcgcttggtggacaaatgtcaccgataacttcaccgcccacccagatatggcagggtatccagttaaagcggattctgagggacagccaggcccacttacttacaatcgaacattggctaaagagcctcctttcttcgcaaaagttttacaaccacatggtggaatggtaatgtttagagcgctagtgtataaccaattaaacgaatcagattggaaagccgacagagccaaagctgctgtggactttttccaaggtctagacggtcaatttgatgataatgtagttgtgcagattaagtacggacctatagactttcaagtcagagaaccaacacctccattatttgctcatctaaggaatacttctacagccatagaactagaagttacgcaagagtacctgggacaacaatgtcatttggtttacttgccacctctattagaagatagaccatctgctctcacatccggtgttaatcaagagtctagaagattggtcagaaatatcattacaggtcaacgttttaacagaactttaggtggggcagcagcagttgtcaacgttggtacaaatacaacctggcttggtagtcaccttgctatgtccaacttgtacgcatacggaagattagcctgggacccagcctcagacgctgaaagagttttgcaagactggatcagacttacattcggtcaggatagaagtgttattgatactattacacaaatgtctatggaatcatggcctgcatacgaaaactattctggtaacttgggaatccaaacccttacagatatcctatacacgcattttggaccaaatccagctagtcaggataataacggctggggccaatggaccagagccgatcataccacaataggaatggatcgtacagtttggaatggcactggctatacagggcaatatccaccagaagtggcagcaatgtacgaaaatatcgatacaacaccagacgatttgctgttatggttccatcatgtgaactatactcatagactacactccggtaagactgtgattcaacatttctatgatgcacactatcgtggagcggaaactgctcaaacctttctgactatgtgggaagcccttaaaggcaaaatcgattccgaaagatataatgacgtgcactttagattgacttaccaagcaggtcactctatcgtatggagggatgcgataacaaacttctactttaatctttcaggtattccagatgaagccgggagagttgaccatcatccttggagagtcgaagctgaatccatgacattatctggttgtaagacttatgcggtttccccatttgaaactgctttcaatacaactgcaatcgttacatctacaaattcaacagtggggaccgcgacaacgaagctagattacagactacatgttaggccaggaagagaactcctgagacatgtaagagggcaagtgcaccttgctggcgtactcaatgacagaaaatcagctaatggctccggaaataaggaagagcatttcggccatacaccttctatctacttagatggacattcagcaacaaggatcacgtttagaggagtgaaaatcggaaaaggtgatgagttaaagattgtcggtactccagatggtgttgagccagccccactagattacgttgctgttttaccaggtggggttgttgacgatgatgatgacaaaggtggttctcctccttctcatcatcaccaccaccactaa

SEQ ID NO: 176 - DNA, 2574 bp, Aspergillus fumigatus
atgtggagcggcattcctatattcgcgctcttatcctccatcggcattgcggccgcagaaacaggtttagacggctggttaagatacgcctctgtcccttgtaacggaaactgccagagagccttaccatctcatatcgtaactctcaattctacaagatcaagcccagtatatgtggctgggcaagagttacaggatggcctgcaccaaatccttggaaaacatgcatcagtgaagtcaacaggctgttccaccgactcttctatcatcgtgggaactgtcgaggcttaccgacaagtttgtaatgcgggacgtcaagtaccacaattcgatgtcgatggattttggctgagtataagagaaaagtcagttttgattgtggggcagtccgagaggggtgcactatatggtgcctatgaatacctgtctatgttggctcaaggtaatttctcacaagtctcctatgcaacaagccctcacgctccaatcagatgggttaatcagtgggataacatggatggttctatcgaaagaggttacggaggcccatcaatctttttcaaagatggcgtaatcagacaagacttatccagagttcaacaatatgcgagattattggcatctgttagaattaacggaataatagtgaataatgttaatgcgaatgctagtttactgatgccttcaaatatggatggattggctaggattgcagatatctttagaccttacggaatccgtgttgggatttcattaaacttcgcatctccaagcaccttgggtaatttgtctacctatgatccattcgacagctcagtcatagcatggtggggtaatgtaacagaccaactatacgccagaatcccagatatggctggatacttagttaaagcaaactctgaaggtcagccaggtccaacaacctacaatagaactttggctgatggtgctaatatgttcgctagggccctgaagccatacggtggtgttgtcatgtttagagctttcgtttacgaccatcacatatctgaggacaattggtacaacgacagagccaatgctgcagtcgactttttcaagcctttggatggtaagtttgatgacaatgtagtcgttcagattaagtatggtcctattgattttcaagtcagagaaccagctagtccattgtttgcaaatttgtataaaaccaatactgctattgaacttcaagttacacaagagtacctaggtcaacagtctcacttagtttatcttccaccactgtggcaaactatattaggattcgatctcagagtagatcaaaaaccatctctcgtgagggatatcatatctggccaaagatttgatagaccactaggcggctgggcagcggtggtgaatgttgggacaaattcaacatggttaggttctcatctagcaatgtctaatctctacgcctatgggagactagcttgggaacctacacttgacagtgaggacattgttcaagattggattagacttacttttgggctagatcgtagaatcgtagacactttgacacaaatgagtatggaatcatggccagcttacgaaaattactctggtaacttaggtattcaaacattgacagacatcctttatacacattacgggcctaatcctgccagtcaagatggtaacggttggggtcaatggacgagagccgatcacttgtccattggcatggatagaaccgtgaaaaacggtactaagttttctggccagtacccagcagaagtagcagccatgtacgaaaacattgaaactactccagataacttgttattgtggtttcatcatgtgaattacacacaaagactacattctggaaagactgttattcaacatttctacgatgcccattacacaggggctgaaacagcacaaacttttgtttcccaatgggagtccttgagagaacgtattgacgctgaaagataccagcatgtgttgacaagactaatataccaagcaggtcattccatcgtttggagagatgctattaacaacttttatcataacctttctggcatcgcagatgaaaaacaaagagtgggtcatcacccttggagagttgaagcagaggacatgcagctcgatggctacgtcccttacgctgttagtccttttgaaacggcctcaaactacacagccatcgttactgcttcaaatggaactaccgggactgcatcagctacattggactttaagactggtacttacgatcttggcattaactactacgacatgtacggcggaaaatctcattggacggtatatttgaacgatcgtgtagttggtcaatggcaaggaaattctgaagatgttttgtcacacacaccatcaatatatctcgacggacattcagcgacgcgaatcacttttagagatgttaaaatccataaaggagatcgtctgaaaatcgtaggtaaaccagatggtgtggagccagctccactagattacgtcgtcgtactgcctccaggtattgtcgacgatgatgatgacaaaggtggttctcctccttctcatcatcaccaccaccactaa

SEQ ID NO: 177 - DNA, 2484 bp, Pyrenophora tritici-repentis
atgttgttgcaagcttttttgtttttgttggctggttttgctgctaaaatttctgctggtccaaaagcaggatgcgacacattgttatctcaaactggccacgagttacaaaagggcatcctaggcatcactggtactcagctgaatttgtcaaccaccccatctgattctgatgccgcaattattgtaggtattgaagatgcgtatttcaatgaatatggaaatcttaatgaaaatgagtatatggagatggatggtttctttcttagcatgtcccctgaaaaggtaataatcgttggtcaaaatgaaagaggtgcgctgtacggggctttcgaatatctctcacagttagcccaaaacaatgtcacttacggatctaaagtctacaaccctcaagtgcctatcagatggaccaatgaatgggacaatatggacggctcaatcgaacatgagttcgctggtccatcaatctttttcagagatggctacgttattgataatactacccgaatagcagagtacgcaagattgcttgcttctgtaggcgttaatggcgtcattatcaacaacgtgaacgccaatgcaacattactttccgatagaaatgtgaagggtttgggcagagttgccgatgctatgcgtccatacggagtccaaatcggcatatctctaaacttcgcttcaccaaaccaaagcctcggtacattcgatcctttggacccaaaggttgatgcctggtgggctaacatcactgaacaaatatactcaaatgttccagacttcgctggttatttggttaaagccaattctgaggggcaaccaggccctttgacttacaataggacactggccgatggtgctaatatgtttgctagagccttagaaccacatgggggtgtggttatgtttcgtgctttcgtttatgataatcatatcaatgaatctaactggcgtgatgacagagcaaatgctcaagtgcaatttttccaggatctagatggtaagttcaatgaaaacgttgtggtccaaattaagtttggtcctatcgactttcaggttcgagaaccagcctcacctctatttggctcattgagatatacatccacggcatttgaagttcaaatatcaccagaatacttgggacaaaactgtcatctgatgtatcttgctccacaatggaaggagattttggaatttgacatgaggtctgacaacagaagttccaaagtaaaagacattattacagggaaaagattcaaaagacctttgggcggttacgctggtgtaagcaatgttggttccgatacaaattggttaggctctcatctagccatgagtaacctatacgccttcggtagattagcctgggatgcatcagtggactcagagacaatccttcaggactggataagactaacatttgggtttgatgaacacgtaatggatacagtcacagatatgtctatgaagtcctggcctgcttatgaaaactattctggcaacttaggaatccaaactcttaccgatatactatacacgcactttggtccaaaccctgcatcacaggacaacaatggttggggccaatggactagagcagatgcctttagtattggaatggatagaacagtcaaaaatggtaccggaaacgctggtctttatccaccagaagttgctaagatatatgacaacatcgaccaaacaccagataatctcttattatggtttcatcacgtcccatacactcaaaagttaaaaagtggcaaaacagtcatccaacatttttacgatgcacattacgagggagcagcaaccgcgcaggagttcgttaagcagtgggaatttctcagaggtaaaatcgatgacgaaagatttgatcatgttctatacaggcaaatataccaagctgggcattctcttgtttggagagatgctatcaacgaattttaccataacttgtctggtattccagacgaaactaaaagggtaggaaatcacccttacagaattgaagccgaatccatgacattgaatggatataaacctgtagctttgaaaccatttgaaacagcgtcagggtacaaagcgatagtcacaattactaataacacaatgggaattgccagtactaaagtggcattcgcatctggtacttacgacattgcagtcaattactttgatttcattggaggaaaggcacgttacagattggaactcggtaacagaacagttggttcatggattggcgatacggaggataagctggggcatacaccaagtatctacttggatggtcattccgctactagaataacgtttcaaggcgtggaagtagaacaaggtgaggaagttagaatcatgggtcaagcagatggaatggaacctgcaccaatcgattacttatcctttttgccaccaggaatcgttgacgatgatgatgacaaaggtggttctcctccttctcatcatcaccaccaccactaa

SEQ ID NO: 178 - DNA, 3045 bp, Schizophyllum commune; identical to SEQ ID NO: 169

SEQ ID NO: 179 - DNA, 3021 bp, Neurospora crassa
atgttcagtcgcgcggcccttgtggcggcggccctggctgctcagcgcgtctatgccctctcagaaggtaattgcgtttcctttgatgcaagctctggtggttttccactggttggggccacaataatcacatccgaagatgattttcctggcgttcatcgtgctgtagcagattttatcgttgacgtagcaaacgttactggtaccgctcctgctgcttttaaccttacggacctcgaaacattgcctagttccgctttaatagtgggaagtgtcaattctactatcatttcacaattatctaactcttacgcagtggatctaagtgctctaacaggccagtgggaaaagtttgcttctggaccagccccagacgcattacctggagttaaaaacgcttacgtgattgcagggtcagataaaagaggtactattttcggcgtttacgaactgtctgagcaaattggcgtgtctccttggtactggtgggcagacgtcccaatctcaaaacatgaggaagtttacctactcccatgcgcacagggtccacctactgtaaaatacaggggcatttttctaaacgatgaggaaccagctttgtccaattgggccaaagcgaaattcactaatggaactctgtcagagttgatgcactcacctttcaatcatcatttttacgaaaagctatttgaattaatccttagactaaaggccaatcacttatggccagccatgtgggggtctgctttttgtgttgatgatgaattgaatcaaccaatggccgactactacggagttgttatgggaacttcacatcaggaaccaatgatgcgttctacaccaaatgaatggaacttattcgggaatggtacttgggattattctaccaatgctgataacatctacccatatttgtacgaaggtgcaaagagagcctcaccatacgaaagtattttctcaatgggtatgagaggtgcaggcgatttgccactttccgacgaaactaatatcgagttactcacacaaattgtagctgacgagagacaaatcctttctgatgtttttaacacaagtgatgtgacaactatcccacaaatctggacattatttcaggaagttcaaggttattacgaacagggtatggaagtaccagaagatattaccctgctgtggagcgatgataattgggggaatgttagacgattccctacccctaatgagagaaatagaaccggaggggctggggtctattatcatgtggactttgttggagatccacgagactacaagtggattgaatctagtcaaattagtaaaatctacgagcaaatgtctttggctgttgaatatgaagcaacaagagtgtggatgttaaacgtgggagatttgaagccttatgagagaagtaccgaatttttcctgacacttgggtggaacgcttccagatggactccagataatgtcggtaccttcgtgacatcatgggcaaaaagagactttcaagttgaagatgcagaggccgaagctatcgcagaaattatcgcgaactttactaagttaaacgctaggagaaagccagaattatggaactccactacttactcacttacaaactatagagaagcacaaaccacattggatgagtggaatgctatcagaaatacgtctacagccatatacgacggcctcccaagcgatgtacaacctgcctacttccaattggtccatcacgcagtccttgccagcgcaaacttgggagaaatgctgattttggcaggtcttaacaatttgtacgcctcacaagctagattaagtactaatgacttagcggataaagtccaagagttgttcgaatatgattatgacctagaagtcgagtaccatagcatattggatggaaagtggaatcacatgatggatcaaacacatgttggttactattactggcaacaaccaatgaccaatacaatgccagcagtaaacagagtacaatctagaaggcaagcgctggcgggtgttatgagaatcatccctgagggcactgctggagcttggccaggagataacccataccaatgtgccaaaggttacgattgtggtgatccaactatctacattgaccgttacagtcctatttctgacagatacgtcgatgtgtctgcaggaggtcctgctccattctcatggaatgttacttctaacgcttcatgggtgtccacctctttacaagggggtgacatcagtcctgattctaaggaagctagactttacttgtctgtcaacgactggtctgctgtcaatggaacctcctatgcacagttgacatttgttgcaatatcctccattgacgatcctctaacagttaatctcacacttgtcgcttacaatccaggcgctccagccgaaggctttactggatacgttgagggtgatggcgtagtttcattcgaagcatcccatgccgctcgtaatacacctgttgacgatctagcatggacagtaattccagattatggtagaacattggcaggcgttactccttggcctagaggtgataaaaactttactgccggcacaggtccaagcctggaatacgatttctacacgttcggtaatgtatcatcagcgaacgtgacagtgtacttgtcaccatcttggaatgctcagggtatgaataattcactatcttacggtctacaagtcgacgaatcagatattgatgtggttgaatatatcccttaccctacaacaataggagggaaaccagctgagtgggcaggtttggacggctttgtagctaacaacatagcaacaggaaaaagcaattttacactttcaggggcaggtgcccataccttgaaattgtggatgacacaaccaactgtagttgttcaaaagatcgttatcgacctgggcggtgcgctggcttcatacttaggtccaccagaatccgtacatgtaggtgcagatgatgatgacaaaggtggttctcctccttctcatcatcaccaccaccactaa

SEQ ID NO: 180 - DNA, 3249 bp, Fusarium sporotrichioides
atgctcctcacgggtgccaaagggacctcatggctcgccttcgcctccgtggtcgcggcccttggacaggaaccaatcatttcatttgataaagcagcaggggcgttacaaatcgctggtggtaagatatctaaagggcaaattagagtcgctaaaaatgaatattggggagttattagagccgctggagacttagcacttgacttcgggagggttacaggtatgaattacactttatctaatggagaaagaggtgcatccccagccgtatacacttacaacccagtggacaatatgaacaatacacattatagtaccaccggcattgccaattttacaggtccagcttacagtgatccttcaccttcagatactgttatcattgctggtacaattggccatagtgaagttatcgatagcttaattgcctctaaaaagttggacgtttcagcaattaaaggaaagtgggaatcttttacctcccaagttatcaaaaatccaatacaaggttgctcttctgctttggttattgctgggtcagatccaagaggaactattttcggcatatatgatgttagtgagcaaattggcgtatctccttggtacttttgggcggatgtcccaactagacaaaacaaaaacatctacgctttgaataagaagaaagtacaaggtccaccttcagtgaaatacagaggatttttccttaatgatgaacaaccagcattgacaaactgggtagaggaacattggggaaggactccatacggggctggttatgggccagcgttctatgggttgatctttgaagtgttacttagattaagagccaactatctgtggccagctgtttggggcactatgtttgaggttgacgatccaggtaaccaaccattcgccgatgcattcgaaatagtgttgggtacatcacacacagagcctatgatgagggctcaaaatgaatttggccatttctatcaaggtccttgggcttacaatcttaacaatgaaactatcgatgactactttcgttacggagtacagagagcgaagccatacgctagaaatagcctatggactatggggatgaggggtacaggagacacagccatcgagggcctcggagttgaccacatcgtagatatgcttactaccctggttcataatcagagacaaatcttggcggaaggtctgggcgtgtctgatgtcacaacaatacctcaagcatggtgtttgtataaagaggtgatgacctacctctttgctggattagaagtgcctgacgatattactttactctgggcagatgataactgggggcatgttagaagattaccactgttgaatgaaaccgcaagagctggtggtgcaggggtatactaccacttcgattacgttggtgaccctagaaattacaagtggataaacactgtgcaattgtcaaagactactgagcagatgcacatgacctacgcaagaggcgcagatagaatctggattgttaatgtcggtgatatgaaggccaacgagattcctatcaatcattggtttgacctaggatatgatatggaaaggtgggacgttgattcaacagaagagtgggctaagacatgggcagcgagggagtttgggtccacctacgccgacgaaataggtgacatcatgatcaaatacgcaatgtacgcatcccgtagaaagtttgaattggttgaaccacaaacatattctgttatcaactacaatgaagccgatgccgttttgcaacaatgggctgaacttagagcacatgcacaggcagtttacgacaaattggacgaagcctataaaccagctttcttcgaaatgatcctgcatccagctattggcggtgaagttgttcatagaatatatgctggaggtgctaaaaacctactatattctggtcaaaagagaaacagtgctaacgaagtaatcaatcaagtcttagctgcatcagatgaagattggcaactacaggaaagatgggatgcattgctaggagggaagtggagacattttatggatcaaactcaccttggttacgacgggtactggcaacaaccaatgagaaacacactccctgctatggtttatgtccagactcgttttgtctctcttgctggtcatgtgggtgtcggtgttgaaggttcaaatgctacagttccaggtgatgataagtaccatgctaattcaggtaacaatcttagtttacctccaatggacccttacggaccagcaacaagatacttcgacgtattttcaagaggcactaaggattgtacatggcaagcagctccttggcaatcttgggtgaagctaagtcagtacaatggcacagtcggcccaaaaggttctgacacgagagtacaagtcagtatcgattggtcccaagctccaaaagctcctttttcatcaacagtaaacattaacgtcacaaattcctgtggtggcggaccaatggtacaagtgccagttcagattagatccgtgccttctaacttcaccaaagggtttgtggagtctgatggacacgtcgcaatcactggcgcacattactctgctatcataccacctaaagagaaatctaaactcaatgataaagttacttaccatactttgtcaaaatacggaagatcaggtagcggcgttggcttggtaccacttaaaaccgaaaaattgacagttgaaacagctccagctttggaatacgatttgtacttattcactaatcatactaaagcaaacgtgacggtcctaatttctccagcacttaattacttaggtgaatggactcctctagagtacggtatatccctatacccagcaggtgcctctacaccatctgaacctaagatggtcagaccagtgggacctacggttggggcaaatatgccagaaggctggggttacgccgtagctgattccgcgtggggcactgtaggtaattacactacaagcacattctcagtaccacaagagggtgcttacaagttgagattttgggctctaatgccaggcattatggttcagaagataattgtggacatgggtggtgtcagaaagtctttctttggacctcctgaatcttttgttgtcggacgtgaccaagttggtagatacaaccaaacatcctttttagcagaagttgatactttgggtggcctatatgaaaaacaagatgatgatgacaaaggtggttctcctccttctcatcatcaccaccaccactaa

SEQ ID NO: 181 - DNA, 3018 bp, Aspergillus fumigatus
atgttgttgcaagcttttttgtttttgttggctggttttgctgctaaaatttctgcttttgaggaaaagatagtagatttcgaacctagtgccggaagtataccactggttggcgcaacaatcgttgtggatcaatcagactatcctggaatcatcagagctgctaaagacttggcccaagattttggtagagtaaccaaaggtgatccatctccagttgtacttttaaagtctgaggaagattacgtgcagattaatacaaaaactgctatatttgtaggttcaatcggcagttcaccattaatcaaaaagttagtcgaaaatggtaagctcgacattcaatcaatcgatgggaagtgggagtcatttgctgcagggattctcaatgaacaattcggtgcttgtgaaagggcattgatcatagcaggttctgataagagaggtgcaatctttggcatatacactttgagtgaacagattggggtgtccccttggtattggtgggcagacgtacctccaaagtatcatacggggatacacgcaatagagaaacaaacagtgcatggagaaccatcagtcagacatagaggaatctttttgaacgacgaagcaccagccttgaccggttgggtaagagaaacgtttggtggatacaatagtaagttttatgctacagtttttgagcttctactaagattaaaggctaatttcctatggcctgcaatgtggcctggttacccaaacccaggcgcatcatttttcactgatgatccacttaaccaaaagctggctgatgaatacggtattgtcatctccacatcccatcatgaacctatgcaaagactctctaatgaatggttcgcagataaccctgacggctcttggaattggctaactaataagcagaagataactgagtttttcgagcatggagcggggagagcccaaggttgcgattcatacttcactttaggtatccgaggggaatacgataagaaaatgcttgcggaagatccagcctctgtagttcaagatgccattgaaactcaaaggaaggtcatcgaaaaggtgtatggaagtgaaggagctgtacctcaattgtttgctatctacaaggaagttcaatccatgtttgaaaccggcaggctgacaattccagaagatgtcactctgctgtttcaagatgataatttcggcactattcgaagattgcctacaacagaagagtccaagagaaagggtggcgctggggtgtattaccacttacagtacgttggtgatccaagatcctacaaatggattaataccaatagcttgggaaaagtatggcaccaactgcaacaagcgtaccaccataatgccaggcagatttgggtctttaatgtcggtgacttaaaaccacaagagctgccaatctcatttgctatggcgctcgcatgggatataaactctatcaaaaacaacacactacctgaatttttccatagagcagcagaaagagaatttggtactgatctagcagatgaaattggttcaatctggcatcaacatgacagactattatccttgcgaaagcatgaacatatcgaaccagagacattcagtatcttacattacaaagaggctgattccatcctcaacagatggaaagttctcctctcccacgctgaaaggttacattctcaggttaccgaagagcagaaagctgcctccttccaactaatattgcatccaacaaaagcctcttatatctacacagccttgagaatctctcaagctagaaacagactcttcgccagacaacgtagaaactctgcgaacaaaatcgcccaggagatattagacctatttgatgcagatttcgatttgtcagaggaatttcattctcttctgaatggcaaatggaaccacattttgatgcaaccacattacggatacgaagatacatggcacgccccatctagagacatgatttctggtttgtcttatgtccaacgtagacaaaattcaaatccaattgtgggccaaatgggcgttgctgttgaaggacatgagggtgtgagagttggcagaattaatgaggaaagtgaacgtacacacccttccagacgagatttggttccaggtttgactttaggaccaatgtcattatatggcccagacttccgttggtttgacgtttttacaagaggtgttcctacgattaactggtcaacctctgcaccatacccttggattatcttgtctagaaccgaaggggttttagtaccaggtcaagatgacgttagagttcaagtctctataaactggtcacaagtgcctcaagattttcaagaggaagtacttattgatgtgcagtctagagagggagactttgaacaagtacatcttctaattgacgggcgtcatgtccaagactctttcagaggtttcgttgaacaggattgttacatttccatccctgctacagactgtcacatggaaaaaccatacctcatgctgcctgatacaggtagacttgagacaggatctgtcactttggccccaggaactagaactaatagtgaaatcccatacatgaaatacccacttttcactcattcagagactgacaaaactgagcttgtcttatactttgggacaacactagacttatctcctgaagatgttttgacttacgacgtccaaattgatgaaggtccatcacaaacctacaatcttcaaagacgaacaccacagtcagagaaaaatgcagcggacaagggatgggcttctgccgatggctggttctttgcagcatccgataatgtctgggttcgtagacacgaattaggtttgttgaaaacaggtgttcataacttgaaattgagactaaaccatgctaatatcttacttgaaaaagttgtagtggatttcggtggagtgcaagagtcttatctcggccctccagggtctacaaaggccgatgatgatgacaaaggtggttctcctccttctcatcatcaccaccaccactaa

SEQ ID NO: 182 - DNA, 3021 bp, Aspergillus nidulans
atgctactgtcagtacttctgactgtcagctgcgtggtaggagctgcacacgctctcggtcaggaaactattgttgctttcgatcaaactaaaggcgcgtacaagttggcaggtaaaaacacggcagcaggcgtcattttgttagatggagatgattggcctggtgttattagagcagctggtgacttggctgttgatttcggaagagttacaggaactaactttacaacaggtttgatcaatggaactactttacatgatcaatcaagcgtgagaggaaatagaggagtcattattgctggcacagtgggtagatccagattaattgattcacttgctgctagaggcaaaatcgatgtatctcaaaccaagggcaaatgggaagcatttcaaacagaagtggtatctaatccattagaaggtatcccaaatgctgttgtaatctccgggagtgacaagaggggagtaatctacggtctttatgacatatctgagcaaattggcgtttctccttggtactggtttgcagatgttgctcctgcacaacataaagaggtttacgctctgaaaaagaagaagatccaaggaccaccatctgtcaaatacagaggtatcttcattaacgatgaacagccagcgttgacgaactggattaacgaaaattacccaccagccagatatggtccaggtttcaacgcagatttttactctcgtgtttttgaacttctgttaagattaagagcgaattacttatggccagctatgtggaataatgcgttttaccctgacgaccctagaaatggtccaacagcagacgaatatggtatagtcatgggaacgtcacacacagaaccaatgatgagagccactaaagagcaatccctatttctagaaggagaatgggattggacctccaatcagaaaaacattacacagtttttcaaggaaggtgcaattaggtcaaaagattgggaagtgctttggaccttgggcatgagaggtaagcacgatacggctaatcctactaatacaaaacaaactctgggagatatcgtcaacacacaacaacaaatactctcagatgtcttaaacatgacaaacatcagttctattccacaaatgtggtgtctctataaggaggttggacaattttacgaggagggtttacgtgcccctgatgatgttactttgttgtgggctgatgacaattgggggaatatacagagactacctctcgggaatgaaaccgctcgttctggtggtgcaggtgtgtactaccattttgattatgttggtgatcctagagattataagtggatcaatactatctcattgcaaaagacatgggaacaaatgcatcttgcttacgaaagacaagcaagacaaatttggatagtcaatatcggggatctaaaaggtgtggagctaccattgaaccatttcctggacctagcttacaatacacctttgtggtcatctccagattctaccctaacatggctaaaccattgggccactagggaatttggaacccaagtatcttctaaagtagccgacatcatggatcgttacgggatgtacgctgccagaaggaagtacgaactcatcgattcatctaccttcagtgtcatcaactataacgaagccgatagagtacaggaagagtggagagcattggttaatgatgctcaaaatgtttaccaagagttgaaagactcagctaggccagcattctttgaattagttttacaaccttgtatggcgggtcaaatagtgaccaacatccatatcacagtggctagaaataacctgtacgctggccaacgtagaacgtcaactaacaccttggctgatcaagctcttaaactgtttaatgacgaccatgccttgacacaaagatatcataagttgttagacggcaaatggaatcatattatggatcaaacgcacctaggatacgattactggcagcagccaatgagaaatacattgccaccactcgcatatactcaagtactggaggaatcattagctggctcaatgggtgtctcagtcgaagcatctaatgcctctgtgccaggtgacgatgtgtggcatagcctttctagtaactctctaactctaccaccaatggacccttacggcccatctacaagatggatggacatatactccagaggtacccatgagttcactttcaccgtaagtccttatgactcttgggtcaaagcaacaccatcctctggcaaaataagtgtgagtgggaataataccgatgcgagaatccatctcagtgttgattgggaaaaggttccaagtggctcacacatggccctgatcaatgtcactatctcttcagatgattacgggaatttcggtatgccaactgtacaacttcctgtaaacaaaactagcgttcctgccgactttcatggcttcgtggaatcagacggtacagtttcaatagaagccgagcacgctactagaaacacatcaagcacagacgtaagttacgcagtaattcctagatacggccatacattgtccggtgttacactgttgccagtcacaattgagacacagcaaccaccttcatcccctcgtttggaatacgacatgtatctgttttcaaatgtgagtacagttaaggccactgtctacctaggcccatcccttaatactgatcactcaagaccactgaaatatgctatttctatcaacgatgccgatcctcaggttgttcagtttgttccatctactccactcggctctttgccatctaactgggaaactactgtgagaaatgccgtttggacaaatacaacatcccatgctatacaaggtggaggcaggaaaaatacccttaagttgtgggcaattgaaccaggagtggtttttcagaaaattgttgttgaccttggcggagttagaccatcctacttagggccaccagagtctatgatcgtagatgatgatgacaaaggtggttctcctccttctcatcatcaccaccaccactaa

SEQ ID NO: 183 - DNA, 3045 bp, Pichia stipitus
atgttgttttcatacttcccagcgttggttgctctttgcagcaccgttagcgcattgggtgggttgcaaaatattgtgttcaaaaatctgaaagacgatttgcaattggctgcacacaaaaagtcggctacgttattcttggatactgaagactggccaggtgttgtcagagctggtttggacttaagtgatgatttcaagaaagtcactggtgaagccttgccagttgtcaattttactggtagtggaatttgtactaaagtacatggtaaggttgaatctgcaattattattggtactgttggcaactcttcaattatcgatacattagtttctgcaaagaagttagatgtcagtgaaattgaaggcaagtgggaatcttatgtcatgaaggttattgagaatccagcaccatgtatcagtagtgctttggtaattgctggaagtgacaagagaggttcaatttttggtgcctatgatatttctgaacaaatcggtgtctctccatggtactggttcgccgacgtcgtgccagctactcatagtgaaatctatgtttccaagtcaatcgtaaaggtccaaggagagcccagtgttaaatacagaggtattttccttaacgatgaacaaccagctttggcagcttgggttgccgaattcttcccagaaggaaaatacaactcttacttcgtccaccaattctacgtgaagttattcgaattgttgctcagaatgagagccaacttcttgtggcccgctatgtgggccagtatgtttggagaggatgatcccgaaaaccagtactgggctgactactatggtattgtcatgtccacatcccacactgagccacttatgagagccactaatgagtggactactttcggtaatggttcttgggattacagtactaacaaagataacatcgttgaattctggaaagaaggtatcgccagaagcaagccatatgaaaacatgtggacaactggtatgagaggattcggagacactcctatcactggtggtgttgaaatcagtttacttgaagacgtcatcaagactcaaagagaacttttaactgagtactttaacaataccgatatcactgatatcccacaagtttggtgtttgtataaggaagttcaagcctacttccaagaaggtatgcaagttcctgaagacattactttgttatgggtggatgataactggggaaacaacagaagattgccccttgctaacgaaacagacagagctggtggtgctggtgtttactatcattttgactacgttggtagtccagttgatttcaagtggattaacactgtttctttggaaaagacttgggaacagatgcatttggcaaaacaaaaacaagctgaccagatctgggttgttaacgttggtgacatgaagcctttagaaattccaattgaatacttcatttctttaggttatgactttgatacatggggaccaattaacaaggtcatgacttgggctaccgcatgggctcaaagagaattcggagcataccttaaggaagacgatgtcaaggaagttgctgacattattgatctttacggtttctatgcaaacagaaagaagtacgaagcattaaacaccaccacatttcatttatacaactacaacgaagccgaaaccgtgcttagtgaatgggcagacttggctgacagagcatgggctgtttacaaaaaattgccaaagaatgttcagccatcatttttccaattggttctccatcctgctgttgctggttacaccgtttacgacattttgatttctgctggtaagaacaacttgtatgctgaacaaagaagaaatcaagctaatgcattatccactcatgtacttgacagattccaatatgacaacacctggaaaggtgaatatgactccttgcttggtggaaaatggaagcatatgatggatcaaactcacttgggctacttctactggcaacagccaatgagaaatgttgctcctccacttgcatatgttcaacttgaagaaaactcattagctggttctttgggtgtcactgtagaacaatccagaggatctgttccaggtgatgatgcttataatgctgttgcatacagtaacaatactttggtattgccaactttagatccttacactgacagtagacacattactattttcaacaaaggtattgaagatttctactttgaggtttctccttatgctgattacgttaaggttaatccctcgtcaggatctgtttctgcaacaaacaacagtatctggaactcggttgatgttgaagtcacggtagactgggaccaggccccagaaggatacaatatcgtgttcatgaatatcacttccaataccacttacgaattctttggtatgccaactgtcaatttgccaatcaacaagactcaagcaccagatgatttcaagggttttgtggagactaaccaacacatctccatcgaagcagaacatttctctaacaaccaatctacaaatgacacatactatgttacaattgacagatatggaagaaccttgtctggtgtcactttgttccccgtcactgctgactcccaagaagcaaccgaagactattcgtacttggaatacaacttgtacagttttagtgcaccacaatatggatctaacattactgtttacactggttcatccttgaacattgatccatctcgtcctttgaagtatgccattgccatcgacgatcaagaacctcaagtagttcaaattgttgttgatccaactgaccctactgccatgcctgcccattgggaagacgctgcaagtgacggtgtatggattcataacactacccatacttttgatgctggtgaacataccttgaaattatgggcattggaaccagcagttgtttttgaaaaagttgttgtcgactttggtggtgttgttccttcgttcttgggaccaccagaaacttacatcaaaaaggatgatgatgacaaaggtggttctcctccttctcatcatcaccaccaccactag

SEQ ID NO: 184 - protein, 1014 aa, Aspergillus oryzae
MKLIWPTSLLFTALVAAEPYLLFSSGTSEYQLASNTTAPAVWVAQNEPVGVLRAAHDLANDFGRVLGVNGTVNVFDTDISESPGKAVIITGTVGQSTPIDQLVSDGKLDVSLIEGKWESYVSRIVENPFPNVTWSLVVAGSDRRGTIYGLYDISEQMGVSPWYWWADVPVKTKTGIWVAPEGTFQKSPSVKYRGFFINDESPALSGWVAENFGTKFNSAFYRHIFELCLRLKGNYLWPAMWGKMFYVDDVDNGQLAHEYGIIMGTSHHEPMARSEQEQKTYLDGEWNWNENQANITTFFQQGIDRAKHWDTIWTMGMRGEGDVASPTLTAADLEELIHAQQKLLVESFNASDPASIPQTWVLYKEVSDYYAAGMEVPESVTLLWTDDNSGNLIRVPIANETSRVAGAGVYYHFDYVGSPRSYKWINSIQLVKTWEQMHLAYQKSARQIWIANVGDIKGLEVPLTHFMDMAYDMDRFTSTDSTTKWLKRWAAREFNERIADRTADILNHYGTLVARRKYELLSQLPFAFSTIYYDEAEANLAQWESLLAQTQSVYSSLDQATRTPFFEMFLHPVLAGKTVVDLYTKTAFNALYHQQGRISTNRLAQKVHDLFTEDSAITERYHGVKGGKWRPVMDQVHIGYSSWDDPVDNTNVMPALSYIAAPQGAGGIGIAVQGSAASYPEQKTLRLLSMDPYMPPSESRYIDIFARKNTTVTYSISSNTSYVTVSNASGSVSASSNISDVRSTITVDWASAEPGLSHTELQVRAGDGFTAALVLPVNNTFVPTNFTGFVESNGVISIEASHYTSAETKSNVSYVEIPHYGRTLSAVMPWPVTMGTQHPNTGPALRYSLYTTTASPSARLIISLGASHNHDPTRLIKFAYSLDGSVPVTVRPVSTVPPYKEGQAWQQAVIENGWTSVIELPGEVGTGEHELSLWLLEPGVVLQKIVLDMGGYQDSALGSPERAVVTEADVLRAEVVEEGSDISPLSRVWRLPSSHDLDDDDKGGSPPSHHHHHH

SEQ ID NO: 185 - protein, 847 aa, Trichoderma reesei
MVIRSLLLLLLAAIVPVFAESGIDAWLRYARLPSSATRGHLTSFPDRIVVLNASKNGPLASASSELHKGIKGILGLDLDVSSRGGKHCSTQKSIVISTLDTYQSACGKLSPKLNLKEDGYWLSTKGGSVQIIGQNERGALYGAFQYLSYLGQGDFSGKAFASNPSAPVRWSNQWDNLNAATAAHGSIERGYGGPSIFFENGLIKEDLSRVPLYGRLLASVGLNGIVINNVNADANLLNETNLQGLKRIADLFRPWGVNVGISLNFASPQVLGDLSTFDPLDDSVIKWWTDKTDRIYQLVPDLAGYLVKANSEGQPGPLTYNRTLAEGANLFAKAVQPHGGIVVFRAFVYDQLNETDWKADRANAAVDFFKSLDGQFDDNVLVQIKYGPIDFQVREPASPLFANLPKTAVSIELEVTQEYLGQQSHLVYLPPLWQTVLGFDMRYNNRQSYVRDIISGEVFGHKLGGYAGVINVGMDDTWLGSHLAMSNMFAYGRLAWNPRADSRDIVEEWTRLTFGLDRDVVSTIADMSLKSWPAYEGYSGNLGIQTLTDILYTHYGANPASQDNNGWGQWTRADSKTIGMDRTVSNGTGNAGQYPKEVAARFEHTQTTPDDLMLWFHHVPYTFRLHSGKSVIQHFYDAHYTGAATVQRFPAAWKSLKSKIDTERYNAVLYKLQYQTGHSLVWRDAITEFYRNLSSIPDQLNRVRNHPHRIEAEDMDLSGFTVVNVSPTECASKYKAIATNGTGTATTRLNVPSGKYTVAVNYYDVINGTASYDVLLNGKSLGKWKGDSETHLGHDFSTFLDCHSAIRITFEGVRISRGDKLTIRGTGNAQEQAAIDYVSILPQGVVD

SEQ ID NO: 186 - protein, 841 aa, Aspergillus niger
MRGLNLFQLILALLLSMVAAEDGYDGWLRYAPVSCDLRCRQALPSHVVLLNSTKGSPIETAGRELKAGFQSILSTNLTSRPFQCNSSTSILVATLDEYRQRCRDINVPELDPDGFWLQSEGDTVRILGKDARGALYGAYEYLAMVAQRNFSRVAYATSPHAPIRWVNQWDNMDGSIERGYGGASIFFKDGTVVEDMAPVEQYARLLASIRINAIVVNNVNANATLLLPENMKGLGRIADACRPYGVQIGISLNFASPEDLGGLNTYDPLDPGVIAWWQNITDSLYTYVPDMAGYLVKADSEGQPGPDTYNRTLSQGANLFARALQPYGGVLMYRAFVYDDNLNESDWKADRAKAAVEYFKDLDGQFEENVVIQIKYGPIDFQVREPTSPLFANLYHTNTAIELEVSQEYLGQQCHLVYLPPLWKTVLDFDLRVDHKPSMVRDIISGQRFNRTLGGWAAVVNVGTNRTWLGSHLAMSNLYAYGRLAWSPTDESEQILEDWTRLTFGQNHHVINTISDMSMTSWPAYENYTGNLGIQTLTDILYTHYGPNPATQDNNGWGQWTRADHDSVGMDRTIRNGTGYTGQYPEEVARVYESLESTPDDLVLWFHHVPWTHRLHSGVTVIQHFYNAHYAGAEAAHGFVRQWESLEGLIDRERYEAMRSRLVYQAGHSIVWRDAINNFYYNMTGIPDVAGRVGHHPWRIEAESMRLDGYQTYTVSPFEAASNTTAIITTSNSTTGTARTSIKAPSGVYDIGVNYYDLYGGQSKWTLSVGDKVVGQWLGDMEHNSLGHTPSIYLDGHSATRITFHGVGIRQGDQLKIVGEANGVEPAPLDYIVLLPPGLVD

SEQ ID NO: 187 - protein, 837 aa, Talaromyces emersonii
MMRRLLLLLSAGLVAAENGLDGWLRYAPLPGASRYLHDLPSSIVALNASETSPVLVAGTELRRGLQGIFGKHVSISHQDCNASSSIVVGTVDEYSKLCGSTAALPELDQDGFLLNTKGNTVQISAVTSAVRSMAGAFEYLSMLAQGNFSQVAYASNPRAPIRWVNQWDNLDGSIERGYGGASIFFENGSVVSNLTRAAQYARLLASIGVNAVVVNNVNANASILTADNIDGLGRIADVFRPYGVQLAISLNFASPTIIGGLNTFDPLDPSVIAWWTNVTDNFTAHPDMAGYPVKADSEGQPGPLTYNRTLAKEPPFFAKVLQPHGGMVMFRALVYNQLNESDWKADRAKAAVDFFQGLDGQFDDNVVVQIKYGPIDFQVREPTPPLFAHLRNTSTAIELEVTQEYLGQQCHLVYLPPLLEDRPSALTSGVNQESRRLVRNIITGQRFNRTLGGAAAVVNVGTNTTWLGSHLAMSNLYAYGRLAWDPASDAERVLQDWIRLTFGQDRSVIDTITQMSMESWPAYENYSGNLGIQTLTDILYTHFGPNPASQDNNGWGQWTRADHTTIGMDRTVWNGTGYTGQYPPEVAAMYENIDTTPDDLLLWFHHVNYTHRLHSGKTVIQHFYDAHYRGAETAQTFLTMWEALKGKIDSERYNDVHFRLTYQAGHSIVWRDAITNFYFNLSGIPDEAGRVDHHPWRVEAESMTLSGCKTYAVSPFETAFNTTAIVTSTNSTVGTATTKLDYRLHVRPGRELLRHVRGQVHLAGVLNDRKSANGSGNKEEHFGHTPSIYLDGHSATRITFRGVKIGKGDELKIVGTPDGVEPAPLDYVAVLPGGVVD

SEQ ID NO: 188 - protein, 958 aa, Chaetomium globosum
MAKKLFITAALAAAVLAAPFKNGDVTSHYQILGSGLTNNRSSASIGNPVNRHYGPLTKKKRLGNSSGLGKVRHHGKVTPASPLDAALSLTTMRSLLLLAAIGFAAAEDGLSGWLRYARIKGANGYHNKLPSAIVTLNATEGSPVYTAGQELSDGISGIFGKDLDFATTSSRKPPRDTTATVGTVSAYIDSNPGAADRLPELVDDGFYLSVSKGNVLILGQNERGALYGAFHYLSLLAQGNASDFTLTSNPEAPIRWVNQWDNMQDGGTHGSVERGYGGDSIFFWDGKIRDDLTRAGQYARLLASIGLNAVVVNNVNADAKTLTPENMDGLGRIADAFRPYGVQLAVSLNFAAPDTLGGLGTFDPLDETVANWWKDITDELYKRIPDMAGYLVKANSEGQPGPMTYNRTLADGANMFAHALKPHGGIILFRAFVYDHRTLNQTLDWKADRANAAGDYFHDLDDKFEDNVVIQIKYGPIDFQVREPVSPLFSHLVKTPSAIELQISQEYLGQQAHLVYLAPMWKEILDFDFRVDGKPSRTSDILNGKRFNRKLGGYAGVVNVGTNTTWLGSHLAMSNLYAYGRLAWDSSATSEGMLEEWIKMTFSDDKKVIDVITKLSMQSWPAYEDYTGNLGIQTLTDILLGHYGPNPASQDGNPWGQWTRADGDSIGMDRTVWNGTGFAGQYPPQIAAMYEKVETTPDNLLLWFHHVPYTQVLKSGKTVIQHFYDAHYEGSAVAQTFPQLWETLRGRPGIDEERFDHVMYRLVYQAGHSLVWRDSINTFYANKSGIADTKGRVGNHPYRIEAEAMKLVGYEPYTVSPFEAASGARCIVTKDNSTRATASVKLEDVKTGKYDVAVNYYDMALGNSTWELYVGCDRIGKWKGDQEYILGRAPSPYIDGQTASRITFKGVHIKKGNTLKIVGHPDGLEPAPLDYVSILPEGTVDDDDDKGGSPPSHHHHHH

SEQ ID NO: 189 - protein, 857 aa, Neosartorya fischeri
MWSGIPVFALLSSIGIAAAENGLDGWLRYASVPCNGNCQRALPSHIVTLNSTKSSQVYVAGQELQDGLHQILGKHASVKSTGCSTDSSIVVGTVEAYRQVCNTGSQAPELDVDGFWLSIRGKSVQIVGQTERGALYGAYEYLSMLAQGNFSQVSYATSPHAPIRWVNQWDNMDGSIERGYGGPSIFFKDGVIPQDLSRVKQYARLLASVRINGIVVNNVNANASLLMPSNMDGLARIADVFRPYGIRVGISLNFASPSTLGNLSTYDPFDSSVIAWWGNVTDQLYARIPDMAGYLVKANSEGQPGPTTYNRTLADGANMFARALKPHGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILRFDLRVDQKPSPVRDIISGQRFDRPLGGWAAVVNVGTNTTWLGSHLAMSNLYAYGRLAWEPTLDSEDIVQDWIRLTFGLDRRVLDTLTQMSMESWPAYENYSGNLGIQTLTDILYTHYGPNPASQDGNGWGQWTRADHLSIGMDRTVKNGTKFSGQYPAEVAAMYENIETTPDNLMLWFHHVNYTQRLHSGKTVIQHFYDAHYDGAETAQTFVSRWESLRERIDAERYQHVLARLIYQAGHSIVWRDAINNFYRNLSGIADEKERVGYHPWRVEAEDMQLDGYVPYAVSPFETASNFTAIVTASNGTTGTASATLDFKTGTYDLGINYYDMYGGKSHWTVYLNDRVVGQWQGNSEDVLSHTPSIYLDGHSATRITFRDVKIHKGDRLKIVGEPDGVEPAPLDYAVVLPRGIVDDDDDKGGSPPSHHHHHH

SEQ ID NO: 190 - protein, 854 aa, Talaromyces emersonii
MMRRLLLLLSAGLVAAENGLDGWLRYAPLPGASRYLHDLPSSIVALNASETSPVLVAGTELRRGLQGIFGKHVSISHQDCNASSSIVVGTVDEYSKLCGSTAALPELDQDGFLLNTKGNTVQISAVTSAVRSMAGAFEYLSMLAQGNFSQVAYASNPRAPIRWVNQWDNLDGSIERGYGGASIFFENGSVVSNLTRAAQYARLLASIGVNAVVVNNVNANASILTADNIDGLGRIADVFRPYGVQLAISLNFASPTIIGGLNTFDPLDPSVIAWWTNVTDNFTAHPDMAGYPVKADSEGQPGPLTYNRTLAKEPPFFAKVLQPHGGMVMFRALVYNQLNESDWKADRAKAAVDFFQGLDGQFDDNVVVQIKYGPIDFQVREPTPPLFAHLRNTSTAIELEVTQEYLGQQCHLVYLPPLLEDRPSALTSGVNQESRRLVRNIITGQRFNRTLGGAAAVVNVGTNTTWLGSHLAMSNLYAYGRLAWDPASDAERVLQDWIRLTFGQDRSVIDTITQMSMESWPAYENYSGNLGIQTLTDILYTHFGPNPASQDNNGWGQWTRADHTTIGMDRTVWNGTGYTGQYPPEVAAMYENIDTTPDDLLLWFHHVNYTHRLHSGKTVIQHFYDAHYRGAETAQTFLTMWEALKGKIDSERYNDVHFRLTYQAGHSIVWRDAITNFYFNLSGIPDEAGRVDHHPWRVEAESMTLSGCKTYAVSPFETAFNTTAIVTSTNSTVGTATTKLDYRLHVRPGRELLRHVRGQVHLAGVLNDRKSANGSGNKEEHFGHTPSIYLDGHSATRITFRGVKIGKGDELKIVGTPDGVEPAPLDYVAVLPGGVVDDDDDKGGSPPSHHHHHH

SEQ ID NO: 191 - protein, 857 aa, Aspergillus fumigatus
MWSGIPIFALLSSIGIAAAETGLDGWLRYASVPCNGNCQRALPSHIVTLNSTRSSPVYVAGQELQDGLHQILGKHASVKSTGCSTDSSIIVGTVEAYRQVCNAGRQVPQFDVDGFWLSIREKSVLIVGQSERGALYGAYEYLSMLAQGNFSQVSYATSPHAPIRWVNQWDNMDGSIERGYGGPSIFFKDGVIRQDLSRVQQYARLLASVRINGIIVNNVNANASLLMPSNMDGLARIADIFRPYGIRVGISLNFASPSTLGNLSTYDPFDSSVIAWWGNVTDQLYARIPDMAGYLVKANSEGQPGPTTYNRTLADGANMFARALKPYGGVVMFRAFVYDHHISEDNWYNDRANAAVDFFKPLDGKFDDNVVVQIKYGPIDFQVREPASPLFANLYKTNTAIELQVTQEYLGQQSHLVYLPPLWQTILGFDLRVDQKPSLVRDIISGQRFDRPLGGWAAVVNVGTNSTWLGSHLAMSNLYAYGRLAWEPTLDSEDIVQDWIRLTFGLDRRIVDTLTQMSMESWPAYENYSGNLGIQTLTDILYTHYGPNPASQDGNGWGQWTRADHLSIGMDRTVKNGTKFSGQYPAEVAAMYENIETTPDNLLLWFHHVNYTQRLHSGKTVIQHFYDAHYTGAETAQTFVSQWESLRERIDAERYQHVLTRLIYQAGHSIVWRDAINNFYHNLSGIADEKQRVGHHPWRVEAEDMQLDGYVPYAVSPFETASNYTAIVTASNGTTGTASATLDFKTGTYDLGINYYDMYGGKSHWTVYLNDRVVGQWQGNSEDVLSHTPSIYLDGHSATRITFRDVKIHKGDRLKIVGKPDGVEPAPLDYVVVLPPGIVDDDDDKGGSPPSHHHHHH

SEQ ID NO: 192 - protein, 827 aa, Pyrenophora tritici-repentis
MLLQAFLFLLAGFAAKISAGPKAGCDTLLSQTGHELQKGILGITGTQLNLSTTPSDSDAAIIVGIEDAYFNEYGNLNENEYMEMDGFFLSMSPEKVIIVGQNERGALYGAFEYLSQLAQNNVTYGSKVYNPQVPIRWTNEWDNMDGSIEHEFAGPSIFFRDGYVIDNTTRIAEYARLLASVGVNGVIINNVNANATLLSDRNVKGLGRVADAMRPYGVQIGISLNFASPNQSLGTFDPLDPKVDAWWANITEQIYSNVPDFAGYLVKANSEGQPGPLTYNRTLADGANMFARALEPHGGVVMFRAFVYDNHINESNWRDDRANAQVQFFQDLDGKFNENVVVQIKFGPIDFQVREPASPLFGSLRYTSTAFEVQISPEYLGQNCHLMYLAPQWKEILEFDMRSDNRSSKVKDIITGKRFKRPLGGYAGVSNVGSDTNWLGSHLAMSNLYAFGRLAWDASVDSETILQDWIRLTFGFDEHVMDTVTDMSMKSWPAYENYSGNLGIQTLTDILYTHFGPNPASQDNNGWGQWTRADAFSIGMDRTVKNGTGNAGLYPPEVAKIYDNIDQTPDNLLLWFHHVPYTQKLKSGKTVIQHFYDAHYEGAATAQEFVKQWEFLRGKIDDERFDHVLYRQIYQAGHSLVWRDAINEFYHNLSGIPDETKRVGNHPYRIEAESMTLNGYKPVALKPFETASGYKAIVTITNNTMGIASTKVAFASGTYDIAVNYFDFIGGKARYRLELGNRTVGSWIGDTEDKLGHTPSIYLDGHSATRITFQGVEVEQGEEVRIMGQADGMEPAPIDYLSFLPPGIVDDDDDKGGSPPSHHHHHH

SEQ ID NO: 193 - protein, 1014 aa, Schizophyllum commune; identical to SEQ ID NO: 184

SEQ ID NO: 194 - protein, 1006 aa, Neurospora crassa
MFSRAALVAAALAAQRVYALSEGNCVSFDASSGGFPLVGATIITSEDDFPGVHRAVADFIVDVANVTGTAPAAFNLTDLETLPSSALIVGSVNSTIISQLSNSYAVDLSALTGQWEKFASGPAPDALPGVKNAYVIAGSDKRGTIFGVYELSEQIGVSPWYWWADVPISKHEEVYLLPCAQGPPTVKYRGIFLNDEEPALSNWAKAKFTNGTLSELMHSPFNHHFYEKLFELILRLKANHLWPAMWGSAFCVDDELNQPMADYYGVVMGTSHQEPMMRSTPNEWNLFGNGTWDYSTNADNIYPYLYEGAKRASPYESIFSMGMRGAGDLPLSDETNIELLTQIVADERQILSDVFNTSDVTTIPQIWTLFQEVQGYYEQGMEVPEDITLLWSDDNWGNVRRFPTPNERNRTGGAGVYYHVDFVGDPRDYKWIESSQISKIYEQMSLAVEYEATRVWMLNVGDLKPYERSTEFFLTLGWNASRWTPDNVGTFVTSWAKRDFQVEDAEAEAIAEIIANFTKLNARRKPELWNSTTYSLTNYREAQTTLDEWNAIRNTSTAIYDGLPSDVQPAYFQLVHHAVLASANLGEMLILAGLNNLYASQARLSTNDLADKVQELFEYDYDLEVEYHSILDGKWNHMMDQTHVGYYYWQQPMTNTMPAVNRVQSRRQALAGVMRIIPEGTAGAWPGDNPYQCAKGYDCGDPTIYIDRYSPISDRYVDVSAGGPAPFSWNVTSNASWVSTSLQGGDISPDSKEARLYLSVNDWSAVNGTSYAQLTFVAISSIDDPLTVNLTLVAYNPGAPAEGFTGYVEGDGVVSFEASHAARNTPVDDLAWTVIPDYGRTLAGVTPWPRGDKNFTAGTGPSLEYDFYTFGNVSSANVTVYLSPSWNAQGMNNSLSYGLQVDESDIDVVEYIPYPTTIGGKPAEWAGLDGFVANNIATGKSNFTLSGAGAHTLKLWMTQPTVVVQKIVIDLGGALASYLGPPESVHVGADDDDKGGSPPSHHHHHH

SEQ ID NO: 195 - protein, 1082 aa, Fusarium sporotrichioides
MLLTGAKGTSWLAFASVVAALGQEPIISFDKAAGALQIAGGKISKGQIRVAKNEYWGVIRAAGDLALDFGRVTGMNYTLSNGERGASPAVYTYNPVDNMNNTHYSTTGIANFTGPAYSDPSPSDTVIIAGTIGHSEVIDSLIASKKLDVSAIKGKWESFTSQVIKNPIQGCSSALVIAGSDPRGTIFGIYDVSEQIGVSPWYFWADVPTRQNKNIYALNKKKVQGPPSVKYRGFFLNDEQPALTNWVEEHWGRTPYGAGYGPAFYGLIFEVLLRLRANYLWPAVWGTMFEVDDPGNQPFADAFEIVLGTSHTEPMMRAQNEFGHFYQGPWAYNLNNETIDDYFRYGVQRAKPYARNSLWTMGMRGTGDTAIEGLGVDHIVDMLTTLVHNQRQILAEGLGVSDVTTIPQAWCLYKEVMTYLFAGLEVPDDITLLWADDNWGHVRRLPLLNETARAGGAGVYYHFDYVGDPRNYKWINTVQLSKTTEQMHMTYARGADRIWIVNVGDMKANEIPINHWFDLGYDMERWDVDSTEEWAKTWAAREFGSTYADEIGDIMIKYAMYASRRKFELVEPQTYSVINYNEADAVLQQWAELRAHAQAVYDKLDEAYKPAFFEMILHPAIGGEVVHRIYAGGAKNLLYSGQKRNSANEVINQVLAASDEDWQLQERWDALLGGKWRHFMDQTHLGYDGYWQQPMRNTLPAMVYVQTRFVSLAGHVGVGVEGSNATVPGDDKYHANSGNNLSLPPMDPYGPATRYFDVFSRGTKDCTWQAAPWQSWVKLSQYNGTVGPKGSDTRVQVSIDWSQAPKAPFSSTVNINVTNSCGGGPMVQVPVQIRSVPSNFTKGFVESDGHVAITGAHYSAIIPPKEKSKLNDKVTYHTLSKYGRSGSGVGLVPLKTEKLTVETAPALEYDLYLFTNHTKANVTVLISPALNYLGEWTPLEYGISLYPAGASTPSEPKMVRPVGPTVGANMPEGWGYAVADSAWGTVGNYTTSTFSVPQEGAYKLRFWALMPGIMVQKIIVDMGGVRKSFFGPPESFVVGRDQVGRYNQTSFLAEVDTLGGLYEKQDDDDKGGSPPSHHHHHH

SEQ ID NO: 196 - protein, 1005 aa, Aspergillus fumigatus
MLLQAFLFLLAGFAAKISAFEEKIVDFEPSAGSIPLVGATIVVDQSDYPGIIRAAKDLAQDFGRVTKGDPSPVVLLKSEEDYVQINTKTAIFVGSIGSSPLIKKLVENGKLDIQSIDGKWESFAAGILNEQFGACERALIIAGSDKRGAIFGIYTLSEQIGVSPWYWWADVPPKYHTGIHAIEKQTVHGEPSVRHRGIFLNDEAPALTGWVRETFGGYNSKFYATVFELLLRLKANFLWPAMWPGYPNPGASFFTDDPLNQKLADEYGIVISTSHHEPMQRLSNEWFADNPDGSWNWLTNKQKITEFFEHGAGRAQGCDSYFTLGIRGEYDKKMLAEDPASVVQDAIETQRKVIEKVYGSEGAVPQLFAIYKEVQSMFETGRLTIPEDVTLLFQDDNFGTIRRLPTTEESKRKGGAGVYYHLQYVGDPRSYKWINTNSLGKVWHQLQQAYHHNARQIWVFNVGDLKPQELPISFAMALAWDINSIKNNTLPEFFHRAAEREFGTDLADEIGSIWHQHDRLLSLRKHEHIEPETFSILHYKEADSILNRWKVLLSHAERLHSQVTEEQKAASFQLILHPTKASYIYTALRISQARNRLFARQRRNSANKIAQEILDLFDADFDLSEEFHSLLNGKWNHILMQPHYGYEDTWHAPSRDMISGLSYVQRRQNSNPIVGQMGVAVEGHEGVRVGRINEESERTHPSRRDLVPGLTLGPMSLYGPDFRWFDVFTRGVPTINWSTSAPYPWIILSRTEGVLVPGQDDVRVQVSINWSQVPQDFQEEVLIDVQSREGDFEQVHLLIDGRHVQDSFRGFVEQDCYISIPATDCHMEKPYLMLPDTGRLETGSVTLAPGTRTNSEIPYMKYPLFTHSETDKTELVLYFGTTLDLSPEDVLTYDVQIDEGPSQTYNLQRRTPQSEKNAADKGWASADGWFFAASDNVWVRRHELGLLKTGVHNLKLRLNHANILLEKVVVDFGGVQESYLGPPGSTKADDDDKGGSPPSHHHHHH

SEQ ID NO: 197 - protein, 1006 aa, Aspergillus nidulans
MLLSVLLTVSCVVGAAHALGQETIVAFDQTKGAYKLAGKNTAAGVILLDGDDWPGVIRAAGDLAVDFGRVTGTNFTTGLINGTTLHDQSSVRGNRGVIIAGTVGRSRLIDSLAARGKIDVSQTKGKWEAFQTEVVSNPLEGIPNAVVISGSDKRGVIYGLYDISEQIGVSPWYWFADVAPAQHKEVYALKKKKIQGPPSVKYRGIFINDEQPALTNWINENYPPARYGPGFNADFYSRVFELLLRLRANYLWPAMWNNAFYPDDPRNGPTADEYGIVMGTSHTEPMMRATKEQSLFLEGEWDWTSNQKNITQFFKEGAIRSKDWEVLWTLGMRGKHDTANPTNTKQTLGDIVNTQQQILSDVLNMTNISSIPQMWCLYKEVGQFYEEGLRAPDDVTLLWADDNWGNIQRLPLGNETARSGGAGVYYHFDYVGDPRDYKWINTISLQKTWEQMHLAYERQARQIWIVNIGDLKGVELPLNHFLDLAYNTPLWSSPDSTLTWLNHWATREFGTQVSSKVADIMDRYGMYAARRKYELIDSSTFSVINYNEADRVQEEWRALVNDAQNVYQELKDSARPAFFELVLQPCMAGQIVTNIHITVARNNLYAGQRRTSTNTLADQALKLFNDDHALTQRYHKLLDGKWNHIMDQTHLGYDYWQQPMRNTLPPLAYTQVLEESLAGSMGVSVEASNASVPGDDVWHSLSSNSLTLPPMDPYGPSTRWMDIYSRGTHEFTFTVSPYDSWVKATPSSGKISVSGNNTDARIHLSVDWEKVPSGSHMALINVTISSDDYGNFGMPTVQLPVNKTSVPADFHGFVESDGTVSIEAEHATRNTSSTDVSYAVIPRYGHTLSGVTLLPVTIETQQPPSSPRLEYDMYLFSNVSTVKATVYLGPSLNTDHSRPLKYAISINDADPQVVQFVPSTPLGSLPSNWETTVRNAVWTNTTSHAIQGGGRKNTLKLWAIEPGVVFQKIVVDLGGVRPSYLGPPESMIVDDDDKGGSPPSHHHHHH

SEQ ID NO: 198 - protein, 1014 aa, Pichia stipitus
MLFSYFPALVALCSTVSALGGLQNIVFKNLKDDLQLAAHKKSATLFLDTEDWPGVVRAGLDLSDDFKKVTGEALPVVNFTGSGICTKVHGKVESAIIIGTVGNSSIIDTLVSAKKLDVSEIEGKWESYVMKVIENPAPCISSALVIAGSDKRGSIFGAYDISEQIGVSPWYWFADVVPATHSEIYVSKSIVKVQGEPSVKYRGIFLNDEQPALAAWVAEFFPEGKYNSYFVHQFYVKLFELLLRMRANFLWPAMWASMFGEDDPENQYWADYYGIVMSTSHTEPLMRATNEWTTFGNGSWDYSTNKDNIVEFWKEGIARSKPYENMWTTGMRGFGDTPITGGVEISLLEDVIKTQRELLTEYFNNTDITDIPQVWCLYKEVQAYFQEGMQVPEDITLLWVDDNWGNNRRLPLANETDRAGGAGVYYHFDYVGSPVDFKWINTVSLEKTWEQMHLAKQKQADQIWVVNVGDMKPLEIPIEYFISLGYDFDTWGPINKVMTWATAWAQREFGAYLKEDDVKEVADIIDLYGFYANRKKYEALNTTTFHLYNYNEAETVLSEWADLADRAWAVYKKLPKNVQPSFFQLVLHPAVAGYTVYDILISAGKNNLYAEQRRNQANALSTHVLDRFQYDNTWKGEYDSLLGGKWKHMMDQTHLGYFYWQQPMRNVAPPLAYVQLEENSLAGSLGVTVEQSRGSVPGDDAYNAVAYSNNTLVLPTLDPYTDSRHITIFNKGIEDFYFEVSPYADYVKVNPSSGSVSATNNSIWNSVDVEVTVDWDQAPEGYNIVFMNITSNTTYEFFGMPTVNLPINKTQAPDDFKGFVETNQHISIEAEHFSNNQSTNDTYYVTIDRYGRTLSGVTLFPVTADSQEATEDYSYLEYNLYSFSAPQYGSNITVYTGSSLNIDPSRPLKYAIAIDDQEPQVVQIVVDPTDPTAMPAHWEDAASDGVWIHNTTHTFDAGEHTLKLWALEPAVVFEKVVVDFGGVVPSFLGPPETYIKKDDDDKGGSPPSHHHHHH

SEQ ID NO: 199 - DNA, 1518 bp, Humicola insolens
atggcaaaagctctaaagtacttcgcatggggactcgctgcactggcttctggagctgttgctgctccatactgtgcaccacaacctagtacaacatctcaagagcctacatccactccatcacctgtaccaggaccacgaacatttgaagcagaagatgccatcttaacggggaccagagtagaaagtagcttggcaggttactcaggtacaggctacgtcgcaggttttgatgaaccatctgacaaaattactttccatgtagattcagaaactacaaggctttatgacttgacaattagagtcgcagcgatatacggtgaaaagcgtactactgttgtgctgaataacggagctgcttctgaagtttacttcccagctggcgattcctttgtcgacatcgcagctgggcaagtgttgttaaaccagggtgataacacgattgatattgtgaataattggggttggtacttaattgactcaattaccatcacaccttcagccccaagacctccacatcagatcaacccatctccagtgaatccagcagccgatgataatgccagagcactctacgcttatctaaggtcaatatacggtaaaaagatactttctggccagcaggaattatcctgggccaattggattgctcaacaaacaggtaagactccagcccttgtctctgttgatatgatggactactctccaagtagagttgaaagaggcacggtcggctccgccgttgaggaagctatagaacaccatagaagaggcggcattgtttcagttctgtggcattggaatgccccaacaggtctgtacgacactcctgagagaagatggtggtccggattttacaccgacgcaactgattttgatgttgctagagcgttagcagacactaccaacgccaattatacattactaataagagatatcgatgctatagctgtacaattgaaaagactgagagatgcgggtgtgcctgtactatggcgtccattacatgaggcagaaggcggctggttctggtggggtgccaaaggaccagaggcgtacaagaaactctggggaatcctttatgacagattgactaactatcatggattgaacaacttgctatgggtttggaacagcattttgccagaatggtacccaggtgatgaaacagtagatatcgtatcagcagacgtttatgcccaaggaaatggtcctatgtcaactcaatacaatcaactaattgaacttgggaaagataaaaagatgatcgctgctacagaagtgggtgctgcgcctttgcctgatttgttgcaagcctatgaggcccattggttgtggtttgctgtttggggtgacaccttcatcaataatccacaatggaacagtatcgagacacttaagacaatctacaattctgattacgtcttaactttagatgaaatccaagggtggagaaatgcacaagatgatgatgacaaaggtggttctcctccttctcatcatcaccaccaccactaa

SEQ ID NO: 200 - DNA, 1482 bp, Chaetomium globosum
atggccagggctctcaaatacttgctctacggagttgctgcctttgccgcgggcacgagtgcggctccagtttgttctgcaccaggtgggggtggggcctcaccacgagtctttgaagctgaggacgccactttgggcggaaccactgttgatacagcacaagccgggttcactggaactggttatgttaccggttttgaagatgcgacagacaaggtaaccttcacaattgactctgagacaactcaactatatgatctttcaatcagagcagcagctatctacggagaaaagagaacgactgtgatactgaacggcggtgcatcctccgaggtgctgtttccagcagcagatacgtgggccgatatagctggtggccaacttttgctcaatgctggtgataatactgttgaaattgtctctaattggggttggtacttaattgactcaattaccttgactccatccgcaccaagacctgcgcatgatatcaacccttcaccagttaatcctagcgctaatgcagatgcaatcgctttgtactcttacttaagatccatctacggtaaacaaattctatcaggacaacaggaattatcatacgctgattggatagccgaacagacagggaaaacacctgctcttgttagtgtcgatctaatggactactctccatctagagtcgagagaggcactgtggggacagcagtagaggaagctattacccatcatgaaagaggtggtatcgtatctgttttgtggcattggaatgcccctactggtttgtacgatactgaggagcaaagatggtggtctggattttacacagcggcaacagactttgatgttgaagccgctttagcatctacaacaaacgcaaactacacattgctgattagggacatagacgcaattgccgttgaattaaagcgtttacaagcagctgaagtcccagtattgtttagaccactacatgaagccgagggaggttggttctggtggggtgctaaaggcccagaaccagctaaaaagctgtgggggatactttatgaacgtttgactgttcatcacgaaatcaacaatttgatttgggtgtggaatagtttagctgaatcctggtatcctggcgacgacacagtagatatcttaagtgctgatgtctatgctcaaggaaatggaccaatgtctacacaatataaccagcttatcgaattgggtaaggataaaaagatgatcgcagcctccgaagttggcgctgctccactacctgatcaactacaagcctacgaagcacattggagctggttcgctgtgtggggtgacacattcatcaataaccctgattggaactcaccagaaaatcttaaaactgtaggatacttaccagctcaatcaattatcagagtaggctcactggatgcgaatagagatgatgatgacaaaggtggttctcctccttctcatcatcaccaccaccactaa

SEQ ID NO: 201 - DNA, 1059 bp, Aspergillus niger
atgttcgccaaattgtccctcctttctcttcttttcagctctgctgcgctgggcgcttcaaaccaaacattatcttatggtaatatcgataaaagtgccactccagaagctagagctttgctaaagtacattcaactgcagtatggttctcattacatttccggccaacaagacattgattcatggaactgggtggagaaaaacattggggttgccccagctatcttgggttccgattttacttactattcaccttctgccgtagctcatggcggcaaatcacatgcagtcgaagatgtcatacaacatgcaggcagaaatggtatcaatgcattagtttggcactggtacgccccaacatgcttactagacaccgctaaggagccttggtacaaaggtttttacacagaagcaacatgttttaacgttagtgaagctgtcaatgatcatggaaacgggacaaattacaaattgttgttgagagatatcgatgcaattgctgcacaaatcaaaagattagatcaagcgaaagttccaatcctatttcgaccactacatgaaccagaaggaggttggttttggtggggtgcacaaggtccagctccattcaaaaagttatgggatatcctctacgatagaattacgcgttaccataacttacacaatatggtttgggtgtgtaataccgctgacccagcatggtaccctggaaatgataagtgtgatattgctactatcgaccattaccctgccgtcggggatcatggagtagccgcagatcaatataagaaattgcagactgttacaaacaatgaaagggtactggcaatggcagaagtgggcccaataccagacccagataagcaagcgagagaaaatgtgaactgggcttactggatggtttggtcaggtgactttatagaggacggaaagcagaatcctaatcaattccttcataaggtctataacgacactagagtagttgccttgaattgggagggagctgatgatgatgacaaaggtggttctcctccttctcatcatcaccaccaccactaa

SEQ ID NO: 202 - DNA, 1437 bp, Chaetomium thermophilum
atgacacgagcgctcaagagtattttgttaggcatagcggctctggcagtaggaacacatgcagtaccttgtcaaggccctagaacttatcaagccgaggatgccgtgcttactggtacgcatatcgataccgctcaaccaggatacactggatctggatacgtcacaggttttgaccaatcatctgataagatcacattcaagatcaatagtccaagcactagattgtacgacctgagcataagagttgctgcaatatacggtgaaaagagaactaccgttgtattaaacggtgcatcctcttcagaagtttactttccagcctctgattcctttatcactgtatcaggtggccaagttttgcttaatgagggcgctaacacactagacatcgtttccaattggggttggtacctgattgattcaattactcttacaccatccgctccaagagctgctcataatatcaacccaaaccctgtgaatccagcagccaacgctgacgccaaagccctatacaattacctcaaatcaatatatggaaagaaaattctatcagggcaacaggaactatcttgggcaaattggatttctcaacaaaccggtaaaacccctgcattagtttctgtagacctcatggattatagtccatctcgtgtcgaaagaggaactgttgggacagcagtcgaggaagcaattcaacatcatgaaagaggcggtattgtgtctgttttgtggcattggaatgccccaactggcttgtacgatactgaggaaaataggtggtggtcagggttttatactagagctacagattttgatgtcgaacaggcattgtcctccaccacaaatgcgaattacacactgattatcagagacatcgatgctatcgctgttcaactcaaaagattacaagatgctggtgtcccagtcttattcaggccacttcacgaagccgaaggcggttggttctggtggggtgccaaagggcctgaaccatgcaaaaagttgtggaatctcctttacgaccgtctgacgaattatcatcaattgaacaacctgttgtgggtatggaacagtatattgccagagtggtacccaggggacgacacagttgatattttgagtgccgacgtgtatgcgcaaggtaacggtttagttgaacttggacaggataagaaaatgatagcagctacagaagtaggcgcagcccctctacctgatttgttacaggcttaccaggttcattggttatggtttgctgtctggtcagatggattcatcaataacgcagagtggaactcattagaaacgttgcaaacaatctacaatcacgattacgtgctaacacttgatgaaattcaaggttggagaaattctgctgatgatgatgacaaaggtggttctcctccttctcatcatcaccaccaccactaa

SEQ ID NO: 203 - DNA, 1461 bp, Podspora anserina
atggtcaagctcctcgacatcgggctcttcgccctggccctggccagcagcgctgttgcgaagccttgtaagccaagagatggcccagtgacttatgaggcagaagatgccatccttactgggactacggtagacactgcacaagtgggatacacaggtagaggatacgttacaggctttgatgaaggatcagataaaatcacattccaaatttcatccgcgacaacaaaattgtacgatttgtctatcagatacgctgcaatatacggtgataaaaggacaaacgttgtgttaaacaacggcgctgttagtgaagtctttttccctgcaggtgactcttttacaagtgtggcagcaggacaagttctgcttaatgcaggacaaaatactattgacattgttaataactggggctggtacctcattgactctattacattaaccccttcagcaccaagaccaccacatgatatcaacccaaatttgaataacccaaatgcggataccaacgccaaaaagctatactcttacttaagatcagtctacggtaataagatcatctccggtcaacaggaacttcatcacgctgaatggattagacaacagacaggtaaaactccagctcttgttgcagtagatttgatggactactcaccatctagagttgaaaggggcacaacatctcatgctgtcgaggatgctatcgctcatcataatgctggtggtattgtatcagtattatggcattggaatgctccagtggggttgtatgatacagaggaaaacaaatggtggtctgggttttacactagagctaccgactttgatatagcagctactcttgctaatccacaaggagctaattacactctgttaatcagagacattgatgcaattgctgttcagctaaaaagattggaagcagccggtgtccctgttttgtggcgtccactacatgaagccgagggagggtggttctggtggggagcaaagggtccagaacctgctaaacaattgtgggacattttgtatgagagactcacagttcatcacggccttgataatctaatctgggtatggaactccatattagaagattggtatccaggtgatgatactgttgacatattgtccgccgatgtgtatgcccaaggtaatggtcctatgtcaactcaatataacgagttgatagcgctaggacgagataaaaagatgattgctgctgccgaagttggcgcagcgccactgcctggcctattgcaggcctaccaagctaattggttatggtttgctgtatggggtgacgacttcatcaataatccatcttggaataccgtcgcagtattaaacgaaatctacaacagtgattacgtcttgacgttagatgaaatacaaggttggagatcagatgatgatgacaaaggtggttctcctccttctcatcatcaccaccaccactaa

SEQ ID NO: 204 - DNA, 1230 bp, Tetrahymena thermophilum
atgaaagaaaaatacctttttttaataatatcattgagtatagtgttatgcacttcaactgaaatgaatttgggatctagtgatttcattgagcaatccctttttaactctgaaatgagcttattcccaacctttccaattagaatgaagggaatcacattcacggacgataagtactgcccagaggttccatacgattccaaagaggccttctattccttaaagcagctcgcttctaccggtgctaactacgtttccatcgtggtaacgttttaccaaaaataccataattcaactgttatctttcctttgtacacccctatcaaatctgattactatacttacgtcactgcaacagatgaagcactaactaaggtcatcaattacgcccatcaaattggattacaagtcatgctcaagccacatattgatctaattgaagatccagaatattggagaggggatattggccttaactttactcaaacacaatggaacgaatggttcgcatcttatactgactatatcttacactttgctaagatgtcagaaaagttgcaagtagaaatgtactccttgtcttgtgaattgattgaagtaagcacccaaacacagcattggatcaaattgataggtcaagttagagaagtatacacaggcatcttgactgatagttcaaattggggctacctggacggtagaggtggcgaagatactcataaagattggtggggttacgttgacgttatcggtatagactcatactatccactggcgcaggacattgatttcccaacagtcaaccaagtgatcgatgcatggcaaccagtgatcgctcgattcaaaaacctgacagaatttttcaatagacctatcatgatttctgagattgggtactgttctggacaatgtaaaagagattatatccctgttaagcaagactttacaaagcaagccatatactatcaagctgcatttgaagccttcagaaatgtagactttccattttacggctacttttggtggtcatggaatacagatcctagagatggaggcagaaaagacaattgtattacaccacagttcaaaaaggctgaggaagttctaaggcattattacggtggtcgttttagattaccaaaacttcctgggagtccagtctgcgagtgtacagttgatgatgatgacaaaggtggttctcctccttctcatcatcaccaccaccactaa

SEQ ID NO: 205 - DNA, 1245 bp, Polysphondylium pallidum
atgaagttttcaaatatattattttgtttgtttgtactttgtacattctcacaatattgcaatgctgttatcaattggtcccaaaaagggatgacctacactaacgataagtactgtccattcgttaggtataacgacagtaaaagcgatttgtcattgtataacttaagatcaagtggtgccaattgggtttctattgtagttacaaactttcaagatacacaaaacactacggcaatctacccagtcccaggcatcacagctacagatgaggaattagaacatgctataaactacgcccataaaatcggactcaacgtgatgcttaaaccacatattgattttatgaaagatccagctcactggagaggtgaaatcggggtctactacaccgagcagcaatgggctgaatggttcgcgaattacacaccatctttggtccattacgctgaaatggccgaaaatcttaaggtggagcaattcagcttaggttgcgaactgatagctacatcttggcgtgacgcacaatggagacaggttgcaaaatctgtaagagatgtttactccggtgttttgacttacgcagctaatcatggcggtgaggaaacaaataagacttggtgggatgtcgtggacattattggtgtagatgcatactatcctctatgcccagaaacacataatgcgactctagccgacatggtcaactactggaatgtcataatgtaccaaggcgttaataacggagaggaacaaatgaccagttccttacacaatctgacagtattctggaacaaaccaatgatttttaccgaattgggctattgttctggcaattgtactactggaccagaagtagacttgggaatacaagatatccaatttcagtctgttttcgaagcattcgccaatgtcccttggtttgaaggcgttcattggtggaattgggtgactgacccagcatttggaggtgaggataactggtgtatgactccacagttcaagcctacagaagttttacttcatgaacaatatgggtcactataccctccaatcagacctaactatccagctgtgtgtccttttaatggttcaattatgaagctctactggctgttttcctactgcaagatcaagattggttacaaaaatcaatgcaaattcacttttcaaatcgttgtgattttgctagatgatgatgacaaaggtggttctcctccttctcatcatcaccaccaccactaa

SEQ ID NO: 206 - DNA, 1158 bp, Dictyostelium fasciculatum
atgttgttgcaagcttttttgtttttgttggctggttttgctgctaaaatttctgctagtctacatgcgaacttgttgttaatcaaccatcatctcgtcaacaataacgcttatagtatccacttttctatagactgtccattcgtgaaattcaatgattctcgttctgacctttcagtttcaaatctcaggtctacaggtgccaattacatcacaatagttgttactaattttcaggattccatcgacacaacaacaatctacccaacaaatttgacggctaccgatgatgagttgacacatgttatcaactacgctcatggactaggacttatggttatgttgaaaccacatattgatctaactaaggacccatcccattggagaggcgacataggtctgaattacaacgatcaagagtgggatgaatggtttacaaattacaatgcgatcttagtccattacgctcaaatgtctcagaaattgggagtggaacaattttccttaggatgtgaattgattgctacctcaccaagagattcacaatggagacaagtagccgcatccgtcagagatgtttacgatggtaagattacttacgctgcaaatcatggtggggaggaaacgaacaagacctggtgggatgttgtagactacattggtgtagacgcatactaccaacctactacactaaacgcaacattagcctcacttactgacatgtggtatgaaataatgtacgtgggactgaataatggtattgaacagatgacaacttcactttataacctgactgtcttttggaataagccaatgattttcaccgaaatcggttactgttctggcgaatgcaccttagggcctggtatcgatttggggtttcaaactgagcattttgaagcagtgtttttagcttttccagacctcaactggttccacggcgttcactggtggaattgggcaagtgatagcgccttcggtggcgataataactggtgcatgactcctcaattcaaaccaacagaagatttgattagagctgagtatggaggcactgaacaaagcgtaagacctgattatccaccactgtgcccatgtattttagatgatgatgacaaaggtggttctcctccttctcatcatcaccaccaccactaa

SEQ ID NO: 207 - DNA, 1098 bp, Trichoderma reesei
atgcggtccattctggtgattccaagcttcgtagcagtactcaacgccttctctttgtttcctaaacctcatgatgatttcaaatacctaattacatttggggattcatacaccgataatgggagactgggctattacggtagccatcaggcacacggtccacctcctggtgttatgccacctgaagctaatgtgacagcttctggtggattgcaatggccacagtacgttgaggcatcaactggcgcaacgctttatgactacgccattgcgggagctacatgtgacaacaataatgtagaaagatgggcagctttcatgaacgctaattacccatcaatcattacagatgaaatcccatcttttaaagctgatagaaaaacaaaattgtatagaggagtgacttcagctaatactgtctacgccctatggataggtactaatgatttgtcttatacaggcatcttatccgactcccaagtaaagggaacaaacataacaacctacattgactgcttgtggaacgtttttgatgccatccatgcagccggtggtagaagatttgtcatacttaacaacaatgctttacaattaacaggcttataccgaccattgtctgacggtggagctggagataaccaattttggcaaaataagacgttgtataatcaaactgaatatgcgcaaaagatgcttgaatacaccacttcctctaacacaatgatcgattacggtgttccattccatctacttgtaaagaaccgttggccaggcagtaaagtcgcagtttatgatatacacagtctaattatggatatctacaatcaaccatcaaggtacctggaacctccacataatgttgtcggatactacaagcattgtgatgttaatggtactaattgtttgtacggcccaggtagattagactcatacttatggtacgacgagttgcatccaagtaatatcatcgccagttacatcgctagagagtttctcaacgtggtttctgggagatcaaaatacggcacttattgggaacattgggatgatgatgacaaaggtggttctcctccttctcatcatcaccaccaccactaa

SEQ ID NO: 208 - DNA, 1107 bp, Aspergillus fumigatus
atgcatcggtggcaattgcttctagggcttgtttttgcaatcgaagcagcttcagctcatccaagatcatggggtcctagaaagttcacaagtctggtttccttcggtgactcctacacagatcagtcaagactaaactactttggttctcataacggatctgcgccaccaataggctgggagcaaccagactctaacaatacagcatctgggggatacgtgtggggacattatgtcagtcagtacgctgacgtgaacttatacaattatgccgtgtctggcgcagtatgctctaatgaaatcacacctagaacttttagttcaatcaatgctcctttcccatctgtactggaatatgaggttagcgcatttttggctgattcaaaacacaaagtttccggtaagagatttttacacattccaccaagggagactgtctactctatatggattggcactaatgacctcggcaactacgctttcattacagattcccaagtcaaggataaaaccatccctgattacattaactgtgtttactcagttttagacagagtttatgtgtctggtggtagatactttgtactcatgaatctggccccattgcaattagctcctttgtacgcaactccagaaaatggtggggtaggcgctaatcattactggccagacaaaccagataacttaactctaacttcatatagaatgtgggaacaagttgcgactgtgaaccatgtttttcaataccaaaccccttacgaacttttggtcgctagaagatacccaggtgctcgttttgccgtcatggacatgtatggtttgttgtctgaagtctactataatccaacaaaatacttcaatggaagcgcacaggccaatgtaacagggtttaacaatcattgtaccttagatggcggtcaatgtacaagactaccaagtcctgattcattcatgtggttcgatgaacttcatccatcccaacgaacagatcaaatcattgccgaagagtttgttaaggttgtaggaggagattcaaagtgggccacgtattgggatgatgatgacaaaggtggttctcctccttctcatcatcaccaccaccactaa

SEQ ID NO: 209 - DNA, 1083 bp, Chaetomium globosum
atgcgtttcacctggatcctcgccggcgcctcgttcgcgctggccaagccaacaaaaggcggcttcgaaactttagttacatttggtgactcatacactgataatgggcgtttaggatactacatcaataacgggggtaaagccccacctccagggaagatgcatgacgaatctacaactactgcttctggtggcctatcatgggctcaatttgctgcaaaagatgctggtgctcaacttagagattatgcagtttctggtgcagtctgttctaatcaaattgttagcaggtcatttgattttatcaacagaacctttccagctattttagatgacgaactgcctagtttcgaggctgatgtggctttcaaatcactttacccaaggagaacagccgagaatacagtatacgcagtgtggattggaacaaatgacttaggctttgatgcatttttgtctgactcccaaacaagaggaaagactatatccgattttgtggactgtgtattctcagttttggacagagtatacaagactggtggtagaagatttgttctcttgaacaccgtcccattggaattgactccactatacgcacatccagataatggaggaactttggattctcaattttggaaaacaaagtctcagtataacatgaccgaatactcccagaaaataagagaatattcaacgagtgtcaacactattttggagtacggagtacctgtcaaagctagtctgcagcacagatggccaaaagccacagttgatctttttgatgtgcattccctagttaatgatatctactctgaacctatcaagtttctaaaagcaccacataacgtcaattcatattaccatcaatgtgaagttgcgggttcaccatgcgttgaccaacctggaagtttggatggttacttatggtacgatgaattacatccatccaacaagacatctgctattatcgctcaaaatttcgttgacgtcgtggtagcaggcaaatcaaagtatggtacaagattccacgatgatgatgacaaaggtggttctcctccttctcatcatcaccaccaccactaa

SEQ ID NO: 210 - DNA, 2685 bp, Saccharomycopsis fibuligera
atggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgcgttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactacaatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaaaaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccagcagatttaaacagagttaatgagtacctttatccatatttagatagcaatgttaccttaaaagacggaaactatgagtatcctgatggctacagcactgagcaaagaacaacacctaaccaacctgggggcggcttgggaggcaacgatgctttgtgggaggtcgcttataactccactgataagtttgttccacagggtaactccactgataagtttgttccacagttgtatttgaaacaccctgaggatggcaagtttgaaacccctattcaattgagagggtttgaaaaggttgagttgtccccgggtgagaagaagacagttgatttgaggcttttgagaagagatcttagtgtgtgggataccaccagacagtcttggatcgttgaatctggtacttatgaggccttaattggcgttgctgttaatgatatcaagacatctgtcctgtttactatttga

SEQ ID NO: 211 - DNA, 2712 bp, Saccharomycopsis fibuligera
atggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgcgttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactacaatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaaaaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccagcagatttaaacagagttaatgagtacctttatccatatttagatagcaatgttaccttaaaagacggaaactatgagtatcctgatggctacagcactgagcaaagaacaacacctaaccaacctgggggcggcttgggaggcaacgatgctttgtgggaggtcgcttataactccactgataagtttgttccacagggtaactccactgataagtttgttccacagttgtatttgaaacaccctgaggatggcaagtttgaaacccctattcaattgagagggtttgaaaaggttgagttgtccccgggtgagaagaagacagttgatttgaggcttttgagaagagatcttagtgtgtgggataccaccagacagtcttggatcgttgaatctggtacttatgaggccttaattggcgttgctgttaatgatatcaagacatctgtcctgtttactattggccggccacatcatcatcatcatcattaa

SEQ ID NO: 212 - DNA, 1314 bp, Trichoderma reesei
atgatgatgctctcaaagagtctcctttccgctgcaactgcagcctcagcgctggccgcggtactgcagcctgttccacgtgcttcgagctttgtaaccatatccggcacccaattcaacatcgatggcaaagtaggctactttgcgggcaccaactgctactggtgctcgttcctgaccaaccacgccgacgttgattccacctttagccacatctcttcctctggcctcaaggtagtccgtgtatggggcttcaacgacgtcaacacgcagccctctcccggccagatctggttccagaagctgtccgctacggggtctacgatcaacacgggagctgatgggctgcagactctcgactacgtagtccagtcagccgagcagcacaacctcaagctcatcatcccgttcgtcaacaactggagcgactacggcgggataaacgcctatgtcaacgcctttggcggcaatgcgaccacctggtacactaacacggccgcgcaaactcagtaccgcaagtacgtccaggccgtcgtcagccgctacgcaaactcgacggccatctttgcgtgggagctgggcaacgagcctcgctgcaacgggtgcagtactgatgtgattgttcagtgggcgacgagtgtgtcccaatatgtcaagtcacttgattcgaaccatctcgtgacgcttggagacgaggggctcggtctcagtactggagacggcgcttatccgtatacttatggcgagggcactgattttgccaagaatgtacaaatcaagtcgcttgactttggtactttccacctctatccggactcttggggaacaaactacacttggggcaatggctggattcagactcatgccgccgcttgtttagcagcaggcaaaccttgcgtgtttgaagaatacggcgcacagcaaaacccctgcaccaacgaggcaccctggcaaacaacctctctcacgactcgcggcatgggtggcgacatgttttggcagtggggagacacttttgccaacggtgcccagtcgaacagtgacccgtacaccgtctggtacaactcatcgaactggcaatgcttggtcaagaaccacgttgatgctattaacggcggtacaaccactcctcctcccgtatcatcgacgacgacaacctcgtctaggacctcgtcgacgcctccaccgcctgggggcagctgctcgcccttgtatggccagtgtggaggttctggatacactggtcccacgtgctgtgcgcagggaacttgtatatattccaactactggtactcgcaatgcctgaatacatga

SEQ ID NO: 213 - DNA, 1371 bp, Saccharophagus degradans 2-40
atggtgaactacttaaagcgcgctgccctgtgcatgcttgcgctcgttgctgtggcttgcgccaaatcgcagccagaaacaaaagttgaagagctgcctgccaccaaaactgcggcaaatgccggtgtggcagcgacagagtttgtgcaagtaaatggtggccgctttacattgcgcgggcaggactacgcctacataggcactaatatgtggtttgccgcgtatattggttctaccaaccctgaatacggcgatcgcgagcgcctaattaaagaactcgatttattaaaatccttgggtgtgaccaacctgcgtattttaggagcatccgaaaaatctccattgcgcgattccatgaaaccggcaattagtgagcgcggtgaaattaaccagcacgatattttagagggcttagattttgcgttagctgaaatggctaagcgcgatatgaaagccgtgatatttctgaataacttttgggaatggtccggcggtatggcgacttacctaagctgggttaacggtggcgaaattgttgatatggcagaccccaccaaaccatggccagcttttgcacttttttcagcggggttttactctaatgaagaggcgaaacaactattcaataattaccttacaaaagttgtaagccgccgcaataccattaccggcgagttgtacgctaacgaccccactattatgtcttggcagctcgctaacgagccgcgcccaggtaacggcgatgtgagcaagtctaacttacccgcctattacgattggataagtaaaaccactcagctaattaaaagcattgcccctaagcagttggtgtcgattggtagcgaaggtaccatgggctgcttagagttggatgagtgcgttattaccgcccacaaagaaacaggtatcgactacgttacattccatatgtggcttaaaaactggggctggttcgatgtgcaaaacgcagagcaaacctacgacagcgcagttgctactgcagataaatatatcgatcaccacattaaactggctaacgagttaaatatgccggtggtgctggaagagtttggtatggagcgcgacggaggtgaattctccccagaaagcgcggtaacctatcgcgataaattctatgcctatgtgttcgatcgccaaattaaaagtattcgctctggcgggccgtttgtagggtccaacttttgggcgtggggcggttatggcaaagccatgcacgatgatgctgtatggcgcaaaggcgataaaacctttgttggtgacccgccgcaggagccgcaaggtttaaatgcggtatttgcttccgatacttcaacgctggaagtgttgaagcaagcggcggacgctattcgg

SEQ ID NO: 214 - DNA, 2184 bp, Clostridium phytofermentans
atgataagaggtaaaaagagagtaattgcaatggcggtatctttatgggttgtcgtagccatgctatttactagtgtacctggacctttggggtcaataataggtacaaaaagcagtacaaaggtacaagctgctgagaaattttcaacgaaattagaagcagagaatggaaagatgactggtactgtaacggtagccactacaaggccagggtatagtggaactggatatgtcaccggttttactcaaaacagcagtaattcctggtcaacttctgtagtgattccgacaactggtcactacacatttacaatccgaagtgctgcagatagttataaagaaaattatctttatattaatggtacacaagctggaattatttatagtacaggtgatggtaaatggggagatactgtcatcgaaagcgtatacttagaggctggaactatcactttatccgtaaaggaaaattggggttggtttgacctagattacattgcaattgaggcgggaagtggtgttgataactctgtttatcagaaggcaacgtctactctagtaaacccgaatgcaaatgaaaaaacaaagaatattatggcatatctaaagagtatctacgggaaaaagactttagcaggtcagtcctgtacgttaaacgcaagcactgaaattgaagcactttataaagcaactggaaaatatcctgcaattcgtatgcttgatttaatcttttgttctccagcaagcgactggcattccacaggagaagttgatttggcacttgactgggataaaaaaggaggactaacgacatttcagtggcattggcatgctccaaaaggtggtgcatctttttataccgataaaacatcatttgatttatccaaagcagtaacatctcaaaatatcagtagattgccattggcagatgtaaaagcattgtatgattcgggtaagatttctgaagaatgttatctgatggttcgcgatatcgatgcaatctctggctatctaaagcaattacaagatgccggtgtcacagttctttggagaccgcttcatgaagcgagtggcggttggttctggtggggcgctgccggaaaagatccatacctttggttatatcgcctcatgtttgatcgccagacgaattatcataaattaaacaacctaatatgggtatggaatggacaggatgcagcttggtatccaggtgatgcctattgtgatatcgtaggaactgatatttatgctgataatcgcaattacagtgcacaaacagctcaatttaataaaacagtaaattatgcgaatggaaataaaatggcagctcttagtgaaaatggtgtaatgattgacccagctttgatgacgagagacaataccttctggttatggtttgcagtatggtatggagatttccttatcgattattcgggcaacctaaatggaacatatactgaggcttctatggtgaaaaaggtttataacagtaatgaggtgataaccttggataaactacctaattttaatggaacaactccaacggtaacaccaacaccaacaccaacagttaagcctacagtaacgccaacagtaacaccgacgccaacagttaagccaacggtaacgccaacagcaacaccgacagcaacaccgacaccaacagttaagccaacagtaacacctacaccaacggttacaccatcagtaacaccaattccaggtagttttactctttctttaaccaatacaggtaataacaatctatcaacaaacacaataaatgctgattttaagattaaacatgagaaaggaagcgatatagatttatctaagctagtgattcgttattattatacgaaggagggaactgcgaaggagaacttctattgtgatactgctgcaatgcaattaaataaagatccatggtacattccatatacatcggtagttaatggaacctttaactcaatggcggtaccaaaaacaaaagcagattcgtatcttgatgtatcgtttaacacaactgataaattatccgcggattctacctttatagtgaatatcagatttacgaagagtgattggagcttgtataaccaagaaaatgattattcttatggagatagtacaaaagttgttgtgtactataatggtaagttggtactaggtgtggagcca

SEQ ID NO: 215 - protein, 505 aa, Humicola insolens
MAKALKYFAWGLAALASGAVAAPYCAPQPSTTSQEPTSTPSPVPGPRTFEAEDAILTGTRVESSLAGYSGTGYVAGFDEPSDKITFHVDSETTRLYDLTIRVAAIYGEKRTTVVLNNGAASEVYFPAGDSFVDIAAGQVLLNQGDNTIDIVNNWGWYLIDSITITPSAPRPPHQINPSPVNPAADDNARALYAYLRSIYGKKILSGQQELSWANWIAQQTGKTPALVSVDMMDYSPSRVERGTVGSAVEEAIEHHRRGGIVSVLWHWNAPTGLYDTPERRWWSGFYTDATDFDVARALADTTNANYTLLIRDIDAIAVQLKRLRDAGVPVLWRPLHEAEGGWFWWGAKGPEAYKKLWGILYDRLTNYHGLNNLLWVWNSILPEWYPGDETVDIVSADVYAQGNGPMSTQYNQLIELGKDKKMIAATEVGAAPLPDLLQAYEAHWLWFAVWGDTFINNPQWNSIETLKTIYNSDYVLTLDEIQGWRNAQDDDDKGGSPPSHHHHHH

SEQ ID NO: 216 - protein, 493 aa, Chaetomium globosum
MARALKYLLYGVAAFAAGTSAAPVCSAPGGGGASPRVFEAEDATLGGTTVDTAQAGFTGTGYVTGFEDATDKVTFTIDSETTQLYDLSIRAAAIYGEKRTTVILNGGASSEVLFPAADTWADIAGGQLLLNAGDNTVEIVSNWGWYLIDSITLTPSAPRPAHDINPSPVNPSANADAIALYSYLRSIYGKQILSGQQELSYADWIAEQTGKTPALVSVDLMDYSPSRVERGTVGTAVEEAITHHERGGIVSVLWHWNAPTGLYDTEEQRWWSGFYTAATDFDVEAALASTTNANYTLLIRDIDAIAVELKRLQAAEVPVLFRPLHEAEGGWFWWGAKGPEPAKKLWGILYERLTVHHEINNLIWVWNSLAESWYPGDDTVDILSADVYAQGNGPMSTQYNQLIELGKDKKMIAASEVGAAPLPDQLQAYEAHWSWFAVWGDTFINNPDWNSPENLKTVGYLPAQSIIRVGSLDANRDDDDKGGSPPSHHHHHH

SEQ ID NO: 217 - protein, 352 aa, Aspergillus niger
MFAKLSLLSLLFSSAALGASNQTLSYGNIDKSATPEARALLKYIQLQYGSHYISGQQDIDSWNWVEKNIGVAPAILGSDFTYYSPSAVAHGGKSHAVEDVIQHAGRNGINALVWHWYAPTCLLDTAKEPWYKGFYTEATCFNVSEAVNDHGNGTNYKLLLRDIDAIAAQIKRLDQAKVPILFRPLHEPEGGWFWWGAQGPAPFKKLWDILYDRITRYHNLHNMVWVCNTADPAWYPGNDKCDIATIDHYPAVGDHGVAADQYKKLQTVTNNERVLAMAEVGPIPDPDKQARENVNWAYWMVWSGDFIEDGKQNPNQFLHKVYNDTRVVALNWEGADDDDKGGSPPSHHHHHH

SEQ ID NO: 218 - protein, 478 aa, Chaetomium thermophilum
MTRALKSILLGIAALAVGTHAVPCQGPRTYQAEDAVLTGTHIDTAQPGYTGSGYVTGFDQSSDKITFKINSPSTRLYDLSIRVAAIYGEKRTTVVLNGASSSEVYFPASDSFITVSGGQVLLNEGANTLDIVSNWGWYLIDSITLTPSAPRAAHNINPNPVNPAANADAKALYNYLKSIYGKKILSGQQELSWANWISQQTGKTPALVSVDLMDYSPSRVERGTVGTAVEEAIQHHERGGIVSVLWHWNAPTGLYDTEENRWWSGFYTRATDFDVEQALSSTTNANYTLIIRDIDAIAVQLKRLQDAGVPVLFRPLHEAEGGWFWWGAKGPEPCKKLWNLLYDRLTNYHQLNNLLWVWNSILPEWYPGDDTVDILSADVYAQGNGLVELGQDKKMIAATEVGAAPLPDLLQAYQVHWLWFAVWSDGFINNAEWNSLETLQTIYNHDYVLTLDEIQGWRNSADDDDKGGSPPSHHHHHH

SEQ ID NO: 219 - protein, 486 aa, Podspora anserina
MVKLLDIGLFALALASSAVAKPCKPRDGPVTYEAEDAILTGTTVDTAQVGYTGRGYVTGFDEGSDKITFQISSATTKLYDLSIRYAAIYGDKRTNVVLNNGAVSEVFFPAGDSFTSVAAGQVLLNAGQNTIDIVNNWGWYLIDSITLTPSAPRPPHDINPNLNNPNADTNAKKLYSYLRSVYGNKIISGQQELHHAEWIRQQTGKTPALVAVDLMDYSPSRVERGTTSHAVEDAIAHHNAGGIVSVLWHWNAPVGLYDTEENKWWSGFYTRATDFDIAATLANPQGANYTLLIRDIDAIAVQLKRLEAAGVPVLWRPLHEAEGGWFWWGAKGPEPAKQLWDILYERLTVHHGLDNLIWVWNSILEDWYPGDDTVDILSADVYAQGNGPMSTQYNELIALGRDKKMIAAAEVGAAPLPGLLQAYQANWLWFAVWGDDFINNPSWNTVAVLNEIYNSDYVLTLDEIQGWRSDDDDKGGSPPSHHHHHH

SEQ ID NO: 220 - protein, 409 aa, Tetrahymena thermophilum
MKEKYLFLIISLSIVLCTSTEMNLGSSDFIEQSLFNSEMSLFPTFPIRMKGITFTDDKYCPEVPYDSKEAFYSLKQLASTGANYVSIVVTFYQKYHNSTVIFPLYTPIKSDYYTYVTATDEALTKVINYAHQIGLQVMLKPHIDLIEDPEYWRGDIGLNFTQTQWNEWFASYTDYILHFAKMSEKLQVEMYSLSCELIEVSTQTQHWIKLIGQVREVYTGILTDSSNWGYLDGRGGEDTHKDWWGYVDVIGIDSYYPLAQDIDFPTVNQVIDAWQPVIARFKNLTEFFNRPIMISEIGYCSGQCKRDYIPVKQDFTKQAIYYQAAFEAFRNVDFPFYGYFWWSWNTDPRDGGRKDNCITPQFKKAEEVLRHYYGGRFRLPKLPGSPVCECTVDDDDKGGSPPSHHHHHH

SEQ ID NO: 221 - protein, 414 aa, Polysphondylium pallidum
MKFSNILFCLFVLCTFSQYCNAVINWSQKGMTYTNDKYCPFVRYNDSKSDLSLYNLRSSGANWVSIVVTNFQDTQNTTAIYPVPGITATDEELEHAINYAHKIGLNVMLKPHIDFMKDPAHWRGEIGVYYTEQQWAEWFANYTPSLVHYAEMAENLKVEQFSLGCELIATSWRDAQWRQVAKSVRDVYSGVLTYAANHGGEETNKTWWDVVDIIGVDAYYPLCPETHNATLADMVNYWNVIMYQGVNNGEEQMTSSLHNLTVFWNKPMIFTELGYCSGNCTTGPEVDLGIQDIQFQSVFEAFANVPWFEGVHWWNWVTDPAFGGEDNWCMTPQFKPTEVLLHEQYGSLYPPIRPNYPAVCPFNGSIMKLYWLFSYCKIKIGYKNQCKFTFQIVVILLDDDDKGGSPPSHHHHHH

SEQ ID NO: 222 - protein, 385 aa, Dictyostelium fasciculatum
MLLQAFLFLLAGFAAKISASLHANLLLINHHLVNNNAYSIHFSIDCPFVKFNDSRSDLSVSNLRSTGANYITIVVTNFQDSIDTTTIYPTNLTATDDELTHVINYAHGLGLMVMLKPHIDLTKDPSHWRGDIGLNYNDQEWDEWFTNYNAILVHYAQMSQKLGVEQFSLGCELIATSPRDSQWRQVAASVRDVYDGKITYAANHGGEETNKTWWDVVDYIGVDAYYQPTTLNATLASLTDMWYEIMYVGLNNGIEQMTTSLYNLTVFWNKPMIFTEIGYCSGECTLGPGIDLGFQTEHFEAVFLAFPDLNWFHGVHWWNWASDSAFGGDNNWCMTPQFKPTEDLIRAEYGGTEQSVRPDYPPLCPCILDDDDKGGSPPSHHHHHH

SEQ ID NO: 223 - protein, 365 aa, Trichoderma reesei
MRSILVIPSFVAVLNAFSLFPKPHDDFKYLITFGDSYTDNGRLGYYGSHQAHGPPPGVMPPEANVTASGGLQWPQYVEASTGATLYDYAIAGATCDNNNVERWAAFMNANYPSIITDEIPSFKADRKTKLYRGVTSANTVYALWIGTNDLSYTGILSDSQVKGTNITTYIDCLWNVFDAIHAAGGRRFVILNNNALQLTGLYRPLSDGGAGDNQFWQNKTLYNQTEYAQKMLEYTTSSNTMIDYGVPFHLLVKNRWPGSKVAVYDIHSLIMDIYNQPSRYLEPPHNVVGYYKHCDVNGTNCLYGPGRLDSYLWYDELHPSNIIASYIAREFLNVVSGRSKYGTYWEHWDDDDKGGSPPSHHHHHH

SEQ ID NO: 224 - protein, 368 aa, Aspergillus fumigatus
MHRWQLLLGLVFAIEAASAHPRSWGPRKFTSLVSFGDSYTDQSRLNYFGSHNGSAPPIGWEQPDSNNTASGGYVWGHYVSQYADVNLYNYAVSGAVCSNEITPRTFSSINAPFPSVLEYEVSAFLADSKHKVSGKRFLHIPPRETVYSIWIGTNDLGNYAFITDSQVKDKTIPDYINCVYSVLDRVYVSGGRYFVLMNLAPLQLAPLYATPENGGVGANHYWPDKPDNLTLTSYRMWEQVATVNHVFQYQTPYELLVARRYPGARFAVMDMYGLLSEVYYNPTKYFNGSAQANVTGFNNHCTLDGGQCTRLPSPDSFMWFDELHPSQRTDQIIAEEFVKVVGGDSKWATYWDDDDKGGSPPSHHHHHH

SEQ ID NO: 225 - protein, 360 aa, Chaetomium globosum
MRFTWILAGASFALAKPTKGGFETLVTFGDSYTDNGRLGYYINNGGKAPPPGKMHDESTTTASGGLSWAQFAAKDAGAQLRDYAVSGAVCSNQIVSRSFDFINRTFPAILDDELPSFEADVAFKSLYPRRTAENTVYAVWIGTNDLGFDAFLSDSQTRGKTISDFVDCVFSVLDRVYKTGGRRFVLLNTVPLELTPLYAHPDNGGTLDSQFWKTKSQYNMTEYSQKIREYSTSVNTILEYGVPVKASLQHRWPKATVDLFDVHSLVNDIYSEPIKFLKAPHNVNSYYHQCEVAGSPCVDQPGSLDGYLWYDELHPSNKTSAIIAQNFVDVVVAGKSKYGTRFHDDDDKGGSPPSHHHHHH

SEQ ID NO: 226 - protein, 894 aa, Saccharomycopsis fibuligera
MVSFTSLLAGVAAISGVLAAPAAEVESVAVEKRSRVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTI

SEQ ID NO: 227 - protein, 903 aa, Saccharomycopsis fibuligera
MVSFTSLLAGVAAISGVLAAPAAEVESVAVEKRSRVPIQNYTQSPSQRDESSQWVSPHYYPTPQGGRLQDVWQEAYARAKAIVGQMTIVEKVNLTTGTGWQLDPCVGNTGSVPRFGIPNLCLQDGPLGVRFADFVTGYPSGLATGATFNKDLFLQRGQALGHEFNSKGVHIALGPAVGPLGVKARGGRNFEAFGSDPYLQGTAAAATIKGLQENNVMACVKHFIGNEQEKYRQPDDINPATNQTTKEAISANIPDRAMHALYLWPFADSVRAGVGSVMCSYNRVNNTYACENSYMMNHLLKEELGFQGFVVSDWGAQLSGVYSAISGLDMSMPGEVYGGWNTGTSFWGQNLTKAIYNETVPIERLDDMATRILAALYATNSFPTEDHLPNFSSWTTKEYGNKYYADNTTEIVKVNYNVDPSNDFTEDTALKVAEESIVLLKNENNTLPISPEKAKRLLLSGIAAGPDPIGYQCEDQSCTNGALFQGWGSGSVGSPKYQVTPFEEISYLARKNKMQFDYIRESYDLAQVTKVASDAHLSIVVVSAASGEGYITVDGNQGDRKNLTLWNNGDKLIETVAENCANTVVVVTSTGQINFEGFADHPNVTAIVWAGPLGDRSGTAIANILFGKANPSGHLPFTIAKTDDDYIPIETYSPSSGEPEDNHLVENDLLVDYRYFEEKNIEPRYAFGYGLSYNEYEVSNAKVSAAKKVDEELPEPATYLSEFSYQNAKDSKNPSDAFAPADLNRVNEYLYPYLDSNVTLKDGNYEYPDGYSTEQRTTPNQPGGGLGGNDALWEVAYNSTDKFVPQGNSTDKFVPQLYLKHPEDGKFETPIQLRGFEKVELSPGEKKTVDLRLLRRDLSVWDTTRQSWIVESGTYEALIGVAVNDIKTSVLFTIGRPHHHHHH

SEQ ID NO: 228 - protein, 437 aa, Trichoderma reesei
MMMLSKSLLSAATAASALAAVLQPVPRASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAINGGTTTPPPVSSTTTTSSRTSSTPPPPGGSCSPLYGQCGGSGYTGPTCCAQGTCIYSNYWYSQCLNT

SEQ ID NO: 229 - protein, 457 aa, Saccharophagus degradans 2-40
MVNYLKRAALCMLALVAVACAKSQPETKVEELPATKTAANAGVAATEFVQVNGGRFTLRGQDYAYIGTNMWFAAYIGSTNPEYGDRERLIKELDLLKSLGVTNLRILGASEKSPLRDSMKPAISERGEINQHDILEGLDFALAEMAKRDMKAVIFLNNFWEWSGGMATYLSWVNGGEIVDMADPTKPWPAFALFSAGFYSNEEAKQLFNNYLTKVVSRRNTITGELYANDPTIMSWQLANEPRPGNGDVSKSNLPAYYDWISKTTQLIKSIAPKQLVSIGSEGTMGCLELDECVITAHKETGIDYVTFHMWLKNWGWFDVQNAEQTYDSAVATADKYIDHHIKLANELNMPVVLEEFGMERDGGEFSPESAVTYRDKFYAYVFDRQIKSIRSGGPFVGSNFWAWGGYGKAMHDDAVWRKGDKTFVGDPPQEPQGLNAVFASDTSTLEVLKQAADAIR

SEQ ID NO: 230 - protein, 728 aa, Clostridium phytofermentans
MIRGKKRVIAMAVSLWVVVAMLFTSVPGPLGSIIGTKSSTKVQAAEKFSTKLEAENGKMTGTVTVATTRPGYSGTGYVTGFTQNSSNSWSTSVVIPTTGHYTFTIRSAADSYKENYLYINGTQAGIIYSTGDGKWGDTVIESVYLEAGTITLSVKENWGWFDLDYIAIEAGSGVDNSVYQKATSTLVNPNANEKTKNIMAYLKSIYGKKTLAGQSCTLNASTEIEALYKATGKYPAIRMLDLIFCSPASDWHSTGEVDLALDWDKKGGLTTFQWHWHAPKGGASFYTDKTSFDLSKAVTSQNISRLPLADVKALYDSGKISEECYLMVRDIDAISGYLKQLQDAGVTVLWRPLHEASGGWFWWGAAGKDPYLWLYRLMFDRQTNYHKLNNLIWVWNGQDAAWYPGDAYCDIVGTDIYADNRNYSAQTAQFNKTVNYANGNKMAALSENGVMIDPALMTRDNTFWLWFAVWYGDFLIDYSGNLNGTYTEASMVKKVYNSNEVITLDKLPNFNGTTPTVTPTPTPTVKPTVTPTVTPTPTVKPTVTPTATPTATPTPTVKPTVTPTPTVTPSVTPIPGSFTLSLTNTGNNNLSTNTINADFKIKHEKGSDIDLSKLVIRYYYTKEGTAKENFYCDTAAMQLNKDPWYIPYTSVVNGTFNSMAVPKTKADSYLDVSFNTTDKLSADSTFIVNIRFTKSDWSLYNQENDYSYGDSTKVVVYYNGKLVLGVEP

SEQ ID NO: 231 - DNA, 1380 bp, Aspergillus fumigatus
atgttgttgcaagcttttttgtttttgttggctggttttgctgctaaaatttctgctcaacaaccagctgcttcttctgctggtaatccaaaattgactacttacaagtgtactactgcaggtggttgtgttgctcaagatacttctgttgttttggattggggttatcattggattcatactgttgatggttatacttcttgtactacttcttctggtgttgattctactttgtgtccagatgctgctacttgtgctaaaaactgtgttattgaaccagctaattatacatctgctggtgttactacttctggtgattctttgacaatgtaccaatacgttcaatctaatggtgtttacactaatgcttctccaagattgtatttgttgggtccagataaaaactacgtcatgttgaagttgttgggtcaagaattgacttttgatgttgatttgtctactttgccatgtggtgaaaatggtgctttgtatttgtctgaaatgtctgctactggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacatgcaaaacggtaaggttattgctaatgctgtttcttctacaggtgttaactctattactgaagattggtgtacttcagttgatggttctgctgctacttttggtggtttgactactatgggtaaagctttgggtagaggtatggttttgattttctctatttggaatgatgcttctggttttatgaattggttggattctggtaatgctggtccatgttcttctacagaaggtaatccagatttgattaaggctcaaaatccaactactcatgttgttttctcaaatattagatggggtgatattggttctacttttaaaggttctgatggttctgttactactactacttctacaacttctactaagactactacatctactgctccaggtccaactcaaactcattatggtcaatgtggtggtcaaggttggactggtccaactgcttgtgcttctccatatacttgtcaagttttgaatccatggtactctcaatgcttataa

SEQ ID NO: 232 - DNA, 1407 bp, Neosartorya fischeri
atgttgttgcaagcttttttgtttttgttggctggttttgctgctaaaatttctgctcaacaaccagctacttcttctgctggtaatccaaaattgactacttacaagtgtactactgcaggtggttgtgttgctcaagatacttctgttgttttggattggggttctcattggattcatactgttaatggttacacttcttgtactacatcttctggtgttgattctactttgtgtccagatgaagctacttgtgctaagaattgtgttattgaacctgctaattatacttctgctggtgttgctacttctggtgattctttgacaatgtaccaatacgttcaaaacaatggtgtttacactaatgcttctccaagattgtatttgttgggtccagataaagattacgtaatgttgaagttgttgggtcaagaattgtcttttgatgttgatttgtctactttgccatgtggtgaaaatggtgctttgtatttgtctgaaatgtctgcttctggtggtagaaatgaatacaatactggtggtgctgaatatggttctggttattgtgatgctcaatgtccagttattgcttggaaaaatggtactttgaatacatctggtgcttcatattgttgtaacgaaatggatattttggaagctaattctagagctaattcttatactccacatccatgttctgctactgattgtgataaaggtggttgtggttttaatccatatgctttgggtcaaaaatcttattggggtccaggtggtactgttgatacttctaagccattcactattactactcaattcattacaaacgatggtactactactggtactttgtcagaaattagaagacaatacattcaaaacggtaaggttattgctaatgctgtttcttcagctggtgtttcttctattactgaagattggtgtacatctgttgattcttcagctgctacttttggtggtttgactactatgggtaaagctttgggtagaggtatggttttgattttctctatttggaatgatgcttctggttttatgaattggttggattctggtaattctggtccatgttcttctacagaaggtaatccagatttgattaaggctcaaaatccaactactcatgttgttttctcaaatattagatggggtgatattggttctacttttaagggttctgatgattctggtactacaactactaaaactactactactaagacttctacatctactactagtacaaagactacaacttctactgctccaggtgctactcaaactcattatggtcaatgtggtggtcaaggttggactggtccaactgcttgtgcttctccatatacttgtaaagctcaaaatcaatggtactctcaatgcttataa

SEQ ID NO: 233 - DNA, 1380 bp, Aspergillus clavatus
atgttgttgcaagcttttttgtttttgttggctggttttgctgctaaaatttctgctcaaaatccaggtgctgctgatgctggtaatccaaaattgactacttacaagtgtactactgcaggtggttgtgttaaacaagatacttctgttgttattgattggaactaccattggattcatactgctaatggttatgattcttgtactacttcttctggtgttgattcttctttgtgtcctgatgctgctacttgtgctagaaattgtgttattgaaccagctaattatacatctgctggtgttgctacttctggtgatactttgactatgcatcaatacattaagtctgacggtgaatacgttaatgcttctccaagattgtatttgttgggttcagatggtgattacgttatgatgaaattgttgggtcaagaattgacttttgaagttgatttgtctactttgccatgtggtgaaaatggtgctttgtatttgtctgaaatgtctgctacaggtggtagaaatgaatataacaaaggtggtgctgaatatggttctggttattgtgatgctcaatgtccagttcaaacttggaaaaatggtactttgaacactaatggttcaggtttttgttgtaacgaaatggatattttggaaggtaattctagagctaattcttttactccacatccatgttcttctactgattgtgataaaggtggttgtggttttaatccatatgctttgggtcaacaaaattactggggtccaggtggtactgttgatacttttaagccattcactgttactactcaattcattacttctgatggtactcaaactggtacattgaaagaaattagaagacaatacattcaaaacggtaaagaatggtgtacttctggtgcttcttttggtggtttgactactatgggtcaagctttgggtagaggtatggttttggctttttctatttggaatgataactctcaatttatgaactggttggattctggttctaatggtccatgttcatctacagaaggtaatccagatttgattaaagctcaaaacccaactactcatgttgttttctcaaatattagatggggtgatattggttctactttttctaatccaggtggttcatcttcaagttctactactagaattgttactattactaagccaactactgtttttccaacttctactaagactactactattcaagctccaactactactactacagcttctggtgctactcaaacacaatggggtcaatgtggtggtcaaggttggtcatctccaactgcttgtgctactccatatacttgtcaagctcaaaatgcttggtattctcaatgtgtattataa

SEQ ID NO: 234 - DNA, 1410 bp, Aspergillus terreus
atgttgttgcaagcttttttgtttttgttggctggttttgctgctaaaatttctgctcaacaaccatcttcttcatctccaggtaatccatctttgactacttggaaatgtactactggtggtggttgtttgcaacaagatacttctgttgttttggattggggttttcattggattcatacttctaactctcaatcttgtactacttcttctggtgttaattctgctttgtgtccagatgaagctacttgtgctaagaattgtgttattgatccagctaattatgctactgctggtgttgctacttctggtgatactttgactatgcatcaatactatcaaaacaacggtgttattactaatgcttctccaagattgtatttgttgggttctgatggtaattacgtaatgttgaagttgttgggtcaagaattgtcttttaacgttgatttgtctactttgccatgtggtgaaaatggtgctttgtatttgtctgaaatgtctgctactggtggtagaaatgaatacaatactggtggtgctcaatatggttctggttattgtgatgctcaatctccagttatggcttggagaaatggtactttgaatacttctggtcaaggttttggttgtaacgaaatggatattttggaagctaattctagagctaattcttttactccacatccatgtaatggtaatgattgtgataaaggtggttgtggttttaatccatatgctttgggtcaacaaaattactggggtccaggtggtactgttgatacatctaagccattcactattactactcaattcattactgatgatggtactaaaactggtacattgaaagaaattagaagacaatacattcaaaacggtaagattattgctaatgctaaatcttcagctggtgttgattctattactgaaccatggtgtgaatctgttgatggtgctgctgctacttatggtggtttgaaaagaatgggtgaagctttgggtagaggtatggttttgattttctctatttggaatgatgcaggtggttttatgaattggttggattctggttctgctggtccatgttcttctactgaaggtaacccatctttaattcaatctgctcatccagatactcatgttgttttctcaaatattagatggggtgatattggttctacttatactaatccaggtggttctggttcttcatcttcttctactactacaactactaagactacttctacaacaactactacaaagattactactactacatctgcaggtggtgcaactcaaactcattggggtcaatgtggtggtcaaggttggactggtccaactgcttgtgcttctccatatacttgtcaaaagcaaaatgaatggtactctcaatgcttataa

SEQ ID NO: 235 - DNA, 1383 bp, Trichoderma longibrachiatum
atgttgttgcaagcttttttgtttttgttggctggttttgctgctaaaatttctgctcaacaaccaggtacttctactccagaagttcatccaaaattgactacttacaagtgtactacttctggtggttgtgttgctcaagatacttctgttgttttggattggaattatagatggatgcatgatgctaattacaattcttgtactgttaatggtggtgttaatactactttgtgtccagatgaagctacttgtggtaaaaactgttacattgaaggtgttgattatgctgcttctggtgttactgcttctggttctactttgactttgaatcaatacatgccatcttcatctggtggttattcttcagtttctccaagattgtatttgttgggtccagatggtgaatacgtaatgttgaagttgaatggtcaagaattgtcttttgatgttgatttgtctgctttgccatgtggtgaaaatggttctttgtacttgtctcaaatggatgaaaatggtggtgctaatcaatacaatactgctggtgctaattatggttctggttattgtgatgctcaatgtccagttcaaacttggagaaatggtactttgaatacttctggtcaaggtttttgttgtaacgaaatggatattttggaaggtaattctagagctaatgctttgactccacattcttgtacagctactgcttgtgattctgctggttgtggttttaatccatatggttcaggttatccaaattactttggtccaggtgatactgttgatacttctaagactttcactattattactcaattcaacactgataatggttctccatctggtaatttggtttctattactagaaagtacagacaaaacggtgttgatattccatctgctaaaccaggtggtgatactatttcttcttgtccatctgcttcagcttatggtggtttggctactatgggtaaagctttatcttctggtatggttttggttttttctatttggaacgataactctcaatatatgaactggttggattctggtagagctggtccatgttcttctactgaaggtaatccatctaacattttggctaacaatcctggtactcatgttgtttactcaaatattagatggggtgatattggttctactactaattctactggtggtaatccaccaccacctccacctccagcttcatctactactttttctactactagaagaagttctactacttcttcttctccttcttgtactcaaactcattggggtcaatgtggtggtattggttatactggttgtaaaacttgtacttctggtactacttgtcaatatggtaacgattactactctcaatgcttataa

SEQ ID NO: 236 - DNA, 1482 bp, Penicillium marneffei
atgttgttgcaagcttttttgtttttgttggctggttttgctgctaaaatttctgctcaacaagctccaactccagataatactgtttctttgccaacttggaaatgtacttcttctggtggttgtgttcaacaatctacttctattgttgttgattgggtttatcattggattcatactgttaatggttctacttcttgtactacatcttctggtttaaattctgctttgtgtggtactgaaaaagaatgttacactaactgtgaaatttctccagctacttatgatggtttgggtattagagcttctggtaatgctttgactttgaaccaatacgttacttctaatggtactacaaattctgtttctccaagagtttatttgttggatccagctggtaagaattatgaaatgttgcaattgttgggtcaagaaatttcatttgatgttgatgtttctaatttgccatgtggtgaaaatggtgctttgtatttgtctgaaatggatgctactggtggtagatctcaatataatccagctggtgcttcttatggttctggttattgtgatgctcaatgtggtactggttcttggtttaacggttctattaatactggttcattgggttcttgttgtaatgaaatggatttgtgggaagctaattctcaagctactgctttgactccacatccatgttctgttgatggtccatatggttgttctggttctgcttgtggttctactggtgtttgtgataaaaatggttgtggttttaatccatatgctttgggtgatcataattactatggttcaggttatactgttgatacttctaagccatttactgttactactcaattcgttacatctgatggtacaaaaactggtgctttgactgaaattagaagatcttacgttcaaaacggtaaggttattgctaatgctgttgcttcttcttcatctggtgtttctggtgctaattctattactgaatctttctgtactactatggattctgaagctggtactttgggtggtttgagaactatgggtgaagctttgggtagaggtatggttttgattttctctatttggaatgatgcaggtggttctatgaattggttggattctggtaattctggtccatgttcttctactgctggtgttccatctactattcaagctaatgatccatctacatctgttactttctctaacattaagtggggtgatattggttctacaggtccatctccaggtggttcttcaagttcatcaagttcttcatcaaagtcatcttctactactatttctattactcattctactacttcatcttcagctactactactacaacttctactggtgctactcaaactcattggggtcaatgtggtggtacaggttattctggtccaactgcttgtgctccaccatatacttgtaaagctcaaaatccatactactctcaatgcttataa

SEQ ID NO: 237 - DNA, 1188 bp, Chaetomium globosum
atgttgttgcaagcttttttgtttttgttggctggttttgctgctaaaatttctgctcaacaaccaggttctgttactccagaagttcatccaaaattaccaacttggcaatgtactaaatctggtggttgtgttgaacaagatacttctgttgttttggattggaattacagatggtttcatacttctgataacactacttcttgtactacttcttctggtattgattctactttgtgtccagatgctgctacttgtgctgaaaattgtgttgttgaaggtactgattatacatcttcaggtattgaaacttctggttcttcattgactttaagacaattcgttaaagattctgaaggtaagactaattctgtttctccaagagcttatttgttgggtgctgatggtgattacgtaatgttcaagttgttgaaccaagaattgtcttttgatgttgatgtttctactttgccatgtggtgaaaatgctgctttgtacttttctgaaatggataaaactggtggtagaaatgaacataatactggtggtgcaaaatatggttctggttattgtgatgctcaatgtccagttcaaacttggaacaatggtactttgaatacttctcatcaaggttcttgttgtaacgaaatggatattttggaagctaattctaaagctgaagcttttactccacatccatgtattggtgataattgtgataaaggtggttgtggttttaattcttacgctagaggtaacaaaaattactgggctccaggtggtactttggatacatctaagccatttactatggttactcaattcattactgatgatggtacatcttctggtaaattgtctcaaattgttagatcttacgttcaaaatggtcaaaaagttgcttctgctgtttctggtggtgattctattactgttgaaggttgttcttcttctgatgcttatggtggtttggttggtatgggtgaagctttgggtagaggtatggttttggctatgtctatttggaatgatgcttctggttttatgaattggttggattctggtgataatggtccatgtaatgaaactgaaggtgatccagctaacattttggctaatcatccagattctcaagttgttttgtcaaatattagatggggtgatattgattcaactgttcaattataa

SEQ ID NO: 238 - DNA, 1323 bp, Neurospora crassa
atgttgttgcaagcttttttgtttttgttggctggttttgctgctaaaatttctgctcaacaaattggtactattactccagaatctcatccaaaattgccaactaaaagatgtactttgtctggtggttgtcaaactgtttctacttctattgttttggatgcttttcaaagaccattgcataaaattggtgatccatctactgcttgtgttgttggtggtccattgtgtccagatgctgctacttgtgctgctaattgtgcattggaaggtgttgattatgcttctttgggtgttaaaactgaaggtgatgctttgactttgaatcaatgggtttctgatccatctaatccaggtcattacaaaacatcttctccaagaacttatttggttgctgaagatggtaagaattacgaagctgttaaattgttgggtaaagaaatttcattcgatgttgatgtttctaatttgccatgtggtatgaatggtgctttttacttgtctgaaatgttgatggatggtggtagaggtgaatttaatgctgctggtgctgaatatggtactggttattgtgatgctcaatgtccaaagttggatttcattaatggtgaagctaacattaacaaaactcatggtgcttgttgtaatgaaatggatattttcgaagctaatgctagagctaaatcttttactccacatccatgttctattgaaagggtttacaagtgtactggtgatactgaatgtggtcaatctcaaggtgtttgtgatcaatggggttgtacttataatgaataccaaaagggtgttcatgatttttatggtttggctcctccagctaaaactattgatactactcaaaagttcactgttactactcaatttttgactgataacggtagagaagatggtgttttggttgaaattagaagattgtggtcacaaaacggtaaattgattaagaatgctaagattgctgttgattctttgtctactgattctgtttctacacaattctgtgaaaaaacttcttcttggactatgcaaagaggtggtttgaaaactatgggtgaagctatgggtagaggtatggttttgattttttctatttgggctgatgaatctggttttatgaattggttggattctggtgattcaggtccatgttctgctacagaaggtgatccaaaattgattttgcaaaaaaagccagatgctagagttactttctctaacattaaatggggtgaaatgggttctacttatgcttctgctggtaagtatggtgttagaagagttgctaaaggtttgtctgcattataa

SEQ ID NO: 239 - DNA, 1260 bp, Aspergillus oryzae
atgttgttgcaagcttttttgtttttgttggctggttttgctgctaaaatttctgctcaacaagttggtactactgctgatgctcatccaagattgactacttacaagtgtacttctcaaaatggttgtactagacaaaatacttctttggttttggatgctgctactcattttattcataagaagggtactcaaacttcttgtactaattctaacggtttggatactgctatttgtccagataaacaaacttgtgctgataattgtgttgttgatggtattactgattatgcttcttatggtgttcaaactaagaatgatactttgactttgcaacaatatttgcaaactggtaatgctactaaatctttgtctccaagagtttatttgttggctgaagatggtgaaaattactcaatgttgaagttgttgaaccaagaatttacttttgatgttgatgcttctactttggtttgtggtatgaatggtgctttgtatttgtctgaaatggaagcttctggtggtaaatcttctttgaatcaagctggtgcaaaatatggtactggttattgtgatgctcaatgttatactactccatggattaatggtgaaggtaatactgaatctgttggttcttgttgtcaagaaatggatatttgggaagctaatgctagagctactggtttgactccacatccatgtaatactactggtttgtatgaatgttctggttctggttgtggtgattctggtgtttgtgataaagctggttgtggttttaatccatatggtttgggtgctaaagattattatggttacggtttgaaggttaacactaacgaaactttcactgttgttactcaatttttgactaacgataacactacttctggtcaattgtctgaaattagaagattgtacattcaaaacggtcaagttattcaaaatgctgctgttacttcaggtggtaaaactgttgattctattactaaggatttctgttctggtgaaggttctgcttttaatagattgggtggtttggaagaaatgggtcatgctttgggtagaggtatggttttggctttgtctatttggaatgatgctggttcttttatgcaatggttggatggtggttctgctggtccatgtaatgctacagaaggtaatccagctttgattgaaaaattgtacccagatactcatgttaagttctctaaaattagatggggtgatattggttctacttacagacacttataa

SEQ ID NO: 240 - DNA, 1371 bp, Thielavia heterothallica
atgttgttgcaagcttttttgtttttgttggctggttttgctgctaaaatttctgctcaaactccaggtgaaggtgaagaagttcatccacaaattactacttacagatgtactaaagctgatggttgtgaagaaaagactaactacattgttttggatgctttgtctcatccagttcatcaagttgataatccatacaattgtggtgattggggtcaaaaaccaaatgaaactgcttgtccagatttggaatcttgtgctagaaattgtattatggatccagtttctgattatggtagacatggtgtttctactgatggtacttctttgagattgaaacaattggttggtggtaatgttgtttctccaagagtttatttgttggatgaaactaaagaaagatacgaaatgttgaagttgactggtaatgaatttactttcgatgttgatgctactaaattgccatgtggtatgaactctgctttgtatttgtctgaaatggatgctactggtgctagatctgaattgaatccaggtggtgctacttttggtactggttattgtgatgctcaatgttacgttactccattcattaatggtttgggtaatattgaaggtaaaggtgcttgttgtaacgaaatggatatttgggaagctaatgctagagcacaacatattgctccacatccatgttctaaagctggtccatatttgtgtgaaggtgctgaatgtgaatttgatggtgtttgtgataaaaatggttgtgcttggaatccatatagagttaacgttactgattattatggtgaaggtgcagaatttagagttgatactactagaccattttctgttgttactcaatttagagcaggtggtgatgccggtggtggtaaattggaatcaatttacagattgttcgttcaagatggtagagttattgaatcttacgttgttgataaaccaggtttgccaccaactgatagaatgactgatgaattttgtgctgctacaggtgctgctagatttactgaattgggtgctatggaagctatgggtgatgctttgactagaggtatggttttggctttgtctatttggtggtctgaaggtgataatatgaattggttggattctggtgaagctggtccttgtgatccagatgaaggtaatccatctaacattattagagttcaaccagatccagaagttgttttttctaatttgagatggggtgaaattggttctacttatgaatctgctgttgatggtccagttggtaaaggaaagggtaaaggtaaaggtaaggctccagctggtgatggtaatggtaaagaaaagtctaatggtaagagattcagaagattcttataa

SEQ ID NO: 241 - DNA, 1293 bp, Fusarium oxysporum
atgttgttgcaagcttttttgtttttgttggctggttttgctgctaaaatttctgctcaaactccagataaagctaaagaacaacatccaaagttggaaacttacagatgtactaaagcttctggttgtaagaaacaaactaactacattgttgctgatgctggtattcatggtattagacaaaaaaatggtgctggttgtggtgattggggtcaaaaaccaaatgctactgcttgtccagatgaagcttcttgtgctaagaattgtattttgtctggtatggattctaatgcttacaaaaacgctggtattactacttctggtaacaaattaagattgcaacaattgattaacaaccaattagtttctccaagagtttatttgttggaagaaaacaagaaaaagtacgaaatgttgcatttgactggtactgaattttctttcgatgttgaaatggaaaaattgccatgtggtatgaatggtgctttgtatttgtctgaaatgccacaagatggtggtaaatctacttctagaaattctaaagctggtgcttattacggtgctggttattgtgatgctcaatgttacgttactccattcattaatggtgttggtaacattaaaggtcaaggtgtttgttgtaacgaattggatatttgggaagctaattctagagctactcatattgctccacatccatgttctaaaccaggtttgtatggttgtactggtgatgaatgtggttcttctggtatttgtgataaagcaggttgtggttggaatcataacagaattaacgttactgatttttacggtagaggtaaacaatataaggttgattctactagaaagttcactgttacttctcaatttgttgctaacaaacaaggtgatttgattgaattgcatagacattacattcaagataacaaggttattgaatctgctgttgttaacatttctggtccaccaaagattaatttcattaacgataagtattgtgctgctactggtgctaatgaatatatgagattgggtggtactaaacaaatgggtgatgctatgtctagaggtatggttttggctatgtctgtttggtggtctgaaggtgattttatggcttggttggatcaaggtgttgctggtccatgtgatgctactgaaggtgatccaaagaatattgttaaggttcaaccaaatccagaagttactttctctaacattagaattggtgaaattggttctacttcttctgttaaagctccagcttatccaggtccacatagattataa

SEQ ID NO: 242 - DNA, 1269 bp, Humicola insolens
atgttgttgcaagcttttttgtttttgttggctggttttgctgctaaaatttctgctcaaaaaccaggtgaaactaaagaagttcatccacaattgactacttttagatgtactaaaagaggtggttgtaaaccagctactaatttcattgttgatttgtctttgtctcatccaattcatagagctgaaggtttgggtccaggtggttgtggtgattggggtaatccaccaccaaaagatgtttgtccagatgttgaatcttgtgctaagaactgtattatggaaggtattccagattattctcaatatggtgttactactaatggtacttctttgagattgcaacatattttgccagatggtagagttccatctccaagagtttatttgttggataagactaagagaagatacgaaatgttgcatttgactggttttgaatttactttcgatgttgatgctactaaattgccatgtggtatgaactctgctttgtatttgtctgaaatgcatccaactggtgctaaatctaagtataatccaggtggtgcttattatggtactggttattgtgatgctcaatgttttgttactccattcattaatggtttgggtaatattgaaggtaaaggttcttgttgtaacgaaatggatatttgggaagctaattctagagcttctcatgttgctccacatacttgtaacaaaaagggtttgtacttgtgtgaaggtgaagaatgtgcttttgaaggtgtttgtgataaaaatggttgtggttggaacaattacagagttaacgttactgattattatggtagaggtgaagaatttaaggttaacactttgaagccatttactgttgttactcaatttttggctaatagaagaggtaaattggaaaagattcatagattctacgttcaagatggtaaagttattgaatctttctacactaacaaagaaggtgttccatacactaatatgattgatgatgaattttgtgaagctactggttctagaaaatacatggaattgggtgctactcaaggtatgggtgaagctttgactagaggtatggttttggctatgtctatttggtgggatcaaggtggtaatatggaatggttggatcatggtgaagctggtccatgtgctaaaggtgaaggtgctccatctaatattgttcaagttgaaccatttccagaagttacttacactaatttgagatggggtgaaattggttctacttaccaagaattgcaattataa

SEQ ID NO: 243 - DNA, 1488 bp, Pyrenophora tritici-repentis
atgttgttgcaagcttttttgtttttgttggctggttttgctgctaaaatttctgctgctgttattttgggttgggctagaggttattgtaatagaagatgggattctccaaaatctacttctgaaaagaagtacttcggtattaatactgttgcaatttacaacattgaatctgctgttcaaagattgccatctagaccaagattgcattttttcaaggttttttctatgccaagatacacttttttgactgctgctttggttggtttggcttctgctcaatctttgttgggtactactccagaagttcatccaaaattgaaaacttggaagtgtactaaagcaggtggttgtaaagctgttaattctgctattgttattgatgctggttctcatggtattagacaaaagaacaatccatctttgggttgtggtgattttggttctactccaccaaaatctgtttgtccagataaagaaacttgtgctaagaattgtgttatggatggtatttctgattattctgctttgggtgttactactcaaggttcttcattgagattggacatgttgaactctaaaggtaatgaagcttctccaagagtttatttgttggctgaagatgaaaagaattacgaaatgttgaagttgactggtaatgaatttactttcgatgttgatacttctaaattgccatgtggtatgaatggtgctttgtatttgtctgaaatggctgctaatggtggtagatctaaattgaatccaggtggtgctacttatggtactggttattgtgatgctcaatgttttgttactccatggattaatggtgaaggtaatgttaaaggtcaaggtgtttgttgtaacgaaatggatatttgggaagctaacaaagctgctactcaaattgctccacatacttgttctaagaactctatttttggttgtactggtgatgaatgtggtgcttctggtttgtgtgataaaaatggttgcggtgataatccatacaatcaaagaaaatctccagattattacggtccatctaaaaaagttgatactactaagccatttactgttgttactcaatttccagctaaaaatggtgttttgcaagctattgttagaaaatacgttcaaaacggtaaggttattgaaaatgctatgatgaacttgactatggatcaagctttttgtactgctcaaggtgctacaatgtataacaaattgggtggtcataaaggtatgggtgatgctttgtctagaggtatggttttggctttgtctatttggtgggataaaactggtggtatgaattggttggattctggtgctgctggtccatgttctgctactgaaggttttccagctgaaatcattaaagttgaaccaagaccaactgttactttctcttctattaaatggggtgaaattggttctactttcaaagaacaaggttctactaaagttccattcactgcattataa

SEQ ID NO: 244 - DNA, 1368 bp, Magnaporthe grisea
atgttgttgcaagcttttttgtttttgttggctggttttgctgctaaaatttctgctcaacaaattggtactgaaattccagaaattcatccagaattgccaactcaattttgtactagaaaggatggttgtgttgttagaaagactaagattgttgctgatgtaatgtttagaccaatgcatgttaaggataatgtttctatgccatgtactgctgcttttggtactgctttgtgtccagatgctgctacttgtacaagaaattgtgttttggaaggtgttgattatgattctttgggtgttgctactaaaggtaatgctttgaagttgaaccaatacttgtttaatggtgctgaatacaaaaaagttgctccaagagtttatttgttgggtgaagatgatagaaattacgaattgatgaagttggttaatatggaattggctttcgatgttgatgtttctcaattgggttgtggtatgaatggtgctttgtacttttctgaaatggatgtttctggttctagatctgatttgaatccagctggtgctgcttatggtacaggtgaatgtgatgctcaatgttttcaagatcaaaacttcactgctaatagaatggctactgctttgactccacatacttgttctaaaccatcttcttttagatgtactggtgaagaatgtggtaaaggtaaagctggtgtttgtgataaatctggttgtcaaattaatccatacaagttgggtgataaaaagttttatggtccaggtggtactattgatacaaacaagagattcactgttttgactcaatttgttcacgaacatccagaagctggtattgatatttctagagctggtccattgaaagaaattagaagaaagtacattcaagatggtagagttattgaagatgttcatacttctaatgcttcattttctccattgaaaggtatggatcaaagattttgtgatacttatggttctgaagcttatactagattgggtggtattgttggtactggtcaatctatggctagaggtatggttttgattttctctatttggaactctgaaggtgattttatgaaatggttggatgctggtgatagaggtccatgtggtccaactgatggtgatccaaaaaagattaagcaagaaactccaaatgtttctgttacttactctaacattaaatggggtgaattgggtactgttttgggtcatgatgcttctccaggtgctaaaggtgatgaagctaaagctagattggctgctaattctggtggtgctactgctccagctgttactggtggttctgttttgggtttggctattgttttgttggctttggttcatttgttcttataa

SEQ ID NO: 245 - DNA, 1305 bp, Fusarium graminearum
atgttgttgcaagcttttttgtttttgttggctggttttgctgctaaaatttctgctcaaactccagataaaactcaagaaaagcatccaaagattgaaacttacagatgtactaaagctaaaggttgtaagaaagctacaaactacattgttgctgatgctgaattgcatggtatttctcaagctaatggtcaatcttgtggtaattggggtgaagctgctaattctactgcttgtccagatgaagctacttgtgctaagaattgtaaattgttcggtatgaatgaagctgcttataaagcaaaaggtatttctacttctggtaatgctttgagattggaaatgttgagaaatggtcaatcagtttctccaagagtttatttgttggaagaaaacaagaacaaatacgaaatgttgaaattgactggtgctgaattttcttttgatgttgaaactcaaaaattgccatgtggtatgaatggtgctttgtatttgtctgaaatgccagctgatggtggtaaatctacttctaagtactctaaagttggtgctgctcaaggtggtggttattgtgatgctcaatgttacgttactccattcattaatggtgttggtaacattaaaggtaaaggtgtttgttgtaacgaaatggatatttgggaagctaattctagagctactcatattgctccacatccatgttctgttccaggtttgtatggttgtacaggtgctgaatgtcaaaaagatggtatttgtgataaagctggttgtggttggaatcataatagaaatggtgttccagatttttatggtagaggtaagaattttaaggttgatactactagaaagttcactgttgtttcttcatttccagctgataaatctggtaaattgactgaaatgcatagacattacattcaagatggtaaggttattaagtctgctgttgttactttgccaggtccaccaaaagttactggtaacattattactgataactactgtaaagcttctcatgctgatgattacattagattgggtggtactgaagaaatgggtgatgctatgactagaggtatggttttggctatgtctgtttggtggtctgaaggtgattctatggaatggttggatggtcaaggtgctggtgctggtccatgtactaaagaagaaggtttgccaaagaatattgttaaggttgaaccaaatccagaagttactttctctaacattagaattggtgaaattggttctactcatgctgttaaaatgccaagagtttacggtgctcatagattataa

SEQ ID NO: 246 - DNA, 1425 bp, Hypocrea jecorina
atggtctccttcacctccctgctggccggcgttgccgctatctctggtgtcctagcagcccctgccgcagaagttgaacctgtcgcagttgagaaacgtgaggccgaagcagaagctcaacaaccaggaacatcaacaccagaagtccatccaaagttaacaacctataaatgtactaagagtggagggtgtgtagcgcaggacacaagtgtggtcttagactggaattatcgttggatgcatgatgccaattataattcctgtactgttaacggcggtgttaacactacgttatgccccgatgaagcgacttgtggtaagaattgttttattgaaggggttgactacgccgctagtggtgttacgacgagtgggtcatccttgacgatgaatcaatacatgccttcttctagtggtgggtattcctctgtgtctccaaggctgtatttattggattccgatggggaatatgttatgttaaaattaaatgggcaagaactgagttttgatgtggatctatctgcattaccttgtggagaaaatggtagtctttatttatcacaaatggacgaaaacggcggagccaatcagtacaatacagctggtgctaattatggttcaggctattgtgatgctcaatgtccagtgcagacttggaggaatggcaccttaaacacatcacatcaaggattttgctgtaacgaaatggacatattagaaggtaattcaagagctaatgcactaactccgcactcttgtactgcgaccgcatgtgattctgccggttgtggtttcaacccttatggttctggttataagagttactacggtccgggagacaccgtggatacgtcaaagaccttcactataatcactcagtttaacacagataacggatctccgagtggtaatttggtgagtattactaggaaatatcagcagaacggtgttgatattccgtccgcgcagccaggcggtgacactatatctagctgtccttccgccagtgcctatggcggacttgctacaatgggtaaggcattgtcctcaggtatggtcctagtattttctatttggaatgataattcacaatacatgaattggctggattctggtaatgcaggcccttgctcctctacagaaggtaacccaagcaatatactagctaataacccaaatactcatgttgtctttagtaatattagatggggcgatataggtagcactacgaacagtaccgcacctcctcctccacctgctagctccacgacattttccactactagaaggtccagcactaccagctcatcaccatcttgtactcaaacccattggggacagtgtggtggtataggttacagcggttgcaaaacttgcacatctggtactacatgccaatacagtaatgactattactcacaatgt

SEQ ID NO: 247 - DNA, 1260 bp, Hypocrea jecorina
atgaacaagtctgttgctccattgttgttggctgcttctattttgtatggtggtgctgttgctcaacaaactgtttggggtcaatgtggtggtattggttggtctggtccaactaattgtgctccaggttctgcttgttctactttgaatccatattatgctcaatgtattccaggtgctactactattactacttctactagaccaccatctggtccaacaactactactagagctacttctacatcttcttctactccaccaacttcatctggtgttagatttgctggtgttaacattgctggttttgattttggttgtactactgatggtacttgtgttacttctaaagtttacccaccattgaaaaatttcactggttctaacaattatccagatggtattggtcaaatgcaacattttgttaacgaagatggtatgactatttttagattgccagttggttggcaatatttggttaacaacaatttgggtggtaatttggattctacttctatttctaagtacgatcaattggttcaaggttgtttgtctttgggtgcttactgtattgttgatattcataattatgctagatggaatggtggtattattggtcaaggtggtccaacaaatgctcaatttacttctttgtggtcacaattggcttcaaaatatgcttctcaatctagagtttggtttggtattatgaatgaaccacatgatgttaacattaatacttgggctgctactgttcaagaagttgttactgctattagaaatgctggtgctacttctcaattcatttctttgccaggtaatgattggcaatctgctggtgcttttatttctgatggttctgctgctgctttgtctcaagttactaatccagatggttctactactaatttgatcttcgatgttcataagtacttggattctgataattctggtactcatgctgaatgtactacaaacaatattgatggtgctttttctccattggctacttggttgagacaaaacaatagacaagctattttgactgaaactggtggtggtaatgttcaatcttgtatccaagatatgtgccaacaaattcaatacttgaaccaaaattctgatgtttatttgggttacgttggttggggtgctggttcttttgattctacttacgttttaactgaaactccaacttcttctggtaattcttggactgatacttctttggtttcttcatgtttggctagaaagttataa

SEQ ID NO: 248 - DNA, 1170 bp, Chrysosporium lucknowense
atgaagtcctctattttggcttctgtttttgctactggtgctgttgctcaatctggtccatggcaacaatgtggtggtattggttggcaaggttctactgattgtgtttctggttatcattgtgtttaccaaaatgattggtactctcaatgtgttccaggtgctgcttctactactttgcaaacttctactacatctagaccaactgctacttctactgctccaccatcttctacaacttctccatctaaaggtaaattgaaatggttgggttctaatgaatctggtgctgaatttggtgaaggtaattatccaggtttgtggggtaaacatttcatttttccatctacctctgctattcaaactttgattaacgatggttacaacattttcagaatcgatttctctatggaaagattggttccaaatcaattgacttcttcatttgatgaaggttacttgagaaatttgaccgaagttgttaactttgttactaatgctggtaagtatgctgttttagatccacataattacggaaggtactacggtaatgttattactgataccaatgcttttagaactttttggactaatttggctaaacaattcgcttctaactctttggttattttcgataccaacaacgaatacaatactatggatcaaactttggttttgaatttgaaccaagctgctattgatggtattagagctgctggtgctacttctcaatacattttcgttgaaggtaatgcttggtctggtgcttggtcttggaatactactaatactaatatggctgctttgactgatccacaaaacaaaatcgtttacgaaatgcatcaatacttggattctgattcttctggtactcatgctgaatgtgtttcttctaatattggtgctcaaagagttgttggagctactcaatggttgagagctaatggtaaattgggtgttttgggtgaatttgccggtggtgctaatgctgtttgtcaacaagctgttactggtttgttggatcatttgcaagataattctgaagtttggttgggtgctttgtggtgggctgctggtccatggtggggtgattacatgtattcttttgaaccaccatctggtactggttacgttaattacaactccattttgaaaaagtacttgccataa

SEQ ID NO: 249 - DNA, 1254 bp, Polyporus arcularius
atgcattccttctctggtttgttggttgctgttgctttggctgtttctgttaaagctcaaactactttgtctccagtttggggtcaatgtggtggtactggttggactggtccaactgcttgtgctactggttctgtttgtactaaattgaacgatgctcattttcaatgtgttccaggtactgctactactgctccatcttctccatctactacttcatctgctccagctccaacttcttcttgtcaaattcctgctccatctgctggtaaattgagatttgctggtgttaatattgctggttttgattttggttgttctactgatggtacttgttctgcttctggtgcttggccaccattaactcaatattacggtaatgatggtgaaggtcaaatgcaacattttgttaaggatgatggttttaacgtttttagattgccagttggttggcaatatttgactgatggtgttttgggtggtactattgatgaagataacttcgaagaatatgatgctttggttcaagcttgtttgaatactggtgcttcttgcattattgatattcataactacgctagatggaatggtaagattattggtcaaggtggtccaactaatgaacaatttgctgaattgtggtcatctgttgctgcaaaatatgctaacaactccaagattattttcggtgttatgaatgaaccacatgatgttccagatattaacttgtgggctgaatctgttcaagctgctgttactgctattagaaaagctggtgctacttctcaaattatcttgttgccaggtaacaattggacttctgctgaaacttttatttctaatggttctggtgctgctttgatgaaagttactaatccagatggttctactactaatttggttttcgatgttcataagtacttggattctgataattctggtactcatgaagaatgtgttaccaacaatattgataatgcttgggctccattggctgaatggttgagatgtaatggtagacaagcttttaatactgaaactggtggtggtaatgttgcttcttgtcaacaatttatgtgtgaacaagttgcttttcaaaatgctaactccgatgtttttttgggttacgttggttgggctgctggtaatttctatcaaggttatgctttgggtgaagttccaacttattctaatggtcaatgggttgatacttctttggtttcttcttgtttggctccaaatgctagaaagtaa

SEQ ID NO: 250 - DNA, 1569 bp, Aspergillus kawachii
atgagaatttctaacttgattgttgctgcttctgctgctactatggtttctgctttgccatctagacaaatgaaaaagagggattctggttttaaatgggttggtacttctgaatctggtgctgaatttggttctgctttaccaggtactttgggtactgattatacttggccagaaacttctaaaattcaagttttgagaaacaagggtatgaacatttttagaataccattcttgatggaaagattaactccagatggtttgactggttcttttgcttctacttacttgtctgatttgaagtcaactgttgaatttgttactaattctggtgcttatgctgttttagatccacataattacggtagattcgatggttctattattgaatctacttctgattttaagacttggtggaaaaatgttgctactgaatttgctgataacgataaggttattttcgatacaaacaacgaatatcatgatatggaacaatctttggttttgaatttgaaccaagctgctattaatggtattagagctgctggtgctactactcaatacattttcgttgaaggtaatgcttatactggtgcttgggattggactacttacaatgatgatttgtctggtttaactgattctgaagataagataatatacgaaatgcatcaatacttggattctgattcttctggtacatctgaaacttgtgtttcttctactattggtaaagaaagaattgaaaaggctactgaatggttgaaaactaacaacaagcaaggtattattggtgaatttgcaggtggtgttaattctgtttgtgaagaggctgttgaaggaatgttggcttatatgtctgaaaattctgatgtttgggttggtgcttcttggtggtctgctggtccatggtggggtacttacatgtattctttggaaccaactgatggtactgcttattctacttatttgccaattttggaaaaatacttcccatctggtgatgcttcatcatcttcatctgcttcagcttcagttgcagccgctacttctgctgtttctactactactacagctgcatttgaacaaactactactccagctactcaagttgaaattgcttcttcttcatcttcatcatcagctgttgctgcttcacaaactactttgtctaaggttaagtctaaatctaaatctccatgtaaattgtcatctgctacttcatctgctgtttcatcagctgctgcagttactacacctgcagttgcagctacaactccagctgctgctccaacttcttcttctgttgcttttgctactacttctgtttacgttccaactactactgctgctgcaccatctcaagtttcatcttcagctgcagcttcatcttcaggtgttgttggtgtttctgatccacaaggtccatctgctactaattctgctggtgaagttaatcaatattaccaatgtggtggtattaattggactggtccaactgtttgtgcttctccatatacttgtaaggttcaaaacgattactactatcaatgtgttgctgaattataa

SEQ ID NO: 251 - DNA, 1263 bp, Heterodera schachtii
atgcattgggctgatgttgcttgttctagaccaccatggccaagagattctgttaaagctttgaagtgtaattggaacgctaatgttattagaggtgctatgggtgttgatgaaggtggttatttgtctgatgctaatactgcttacaatttgatggttgctgttattgaagctgctatttctaatggtatctacgttattgttgattggcatgctcataatgctcatccagatgaagctgttaaattctttactagaattgctcaagcttatggttcttacttgcatattttgtacgaagatttcaatgaaccattggatgtttcttggactgatgttttggttccataccataaaaaagttattgctgccattagagctattgataagaagaacgttattatcttgggtactccaaaatggtcacaagatgttgatgttgcttctcaaaatccaattaaggattaccaaaacttgatgtacactttgcatttttacgcttcatctcattttacatctgatttgggtgctaaattgaaaactgctgttaacaatggtttgccagtttttgttactgaatatggtacttgtgaagcttctggtaatggtaatttgaatactgattctatgtcatcttggtggactttgttggattctttgaaaatttcttacgctaattgggctatttctgataaatctgaagcttgttctgctttgtctccaggtactactgctgttaatgttggtgtttcttctagatggacttcttctggtaatatggttgcttcttactacaaaaaaaagtccactggtatttcttgttctggtagttcttcaggttcttcaagtggttcatctagtggttcttccggtacatcttctggttctagtggttcatctagtggtagttcttccggtagttctagtggtagttctggttcaagttctggttcctcctctggttctggttctgcatctatttctgttgttccatctaatacttggaatggtggtggtagagttaattttgaaattaagaacactggttctgttccattgtgtggtgttgttttttctgtttctttgccatctggtactactttgggtggttcttggaatatggaatctgctggttctggtcaatattctttaccatcttgggttagaattgaagctggtaaatcttctaaagatgctggtttgacttttaatggtaaagataagccaactgctaaaattgttaccaccaagaagtgcttataa

SEQ ID NO: 252 - DNA, 1419 bp, Orpinomyces sp.
atgaagttcttgaactctttgtctttgttgggtttggttattgctggttgtgaagctatgagaaacatttcttctaaagaattggttaaagaattgactattggttggtctttgggtaatactttggatgcttcttgtgttgaaactttgaactactctaaagatcaaactgcttctgaaacttgttggggtaatgttaaaactactcaagaattgtactacaaattgtctgatttgggtttcaatactttcagaataccaactacttggtctggtcattttggtgatgctccagattacaaaatttctgatgtttggatgaaaagagttcacgaagttgttgattatgctttgaatactggtggttacgctattttgaacattcatcatgaaacttggaattacgcttttcaaaagaatttggaatctgctaaaaagattttggttgctatttggaaacaaattgctgctgaatttggtgattacgatgaacatttgatttttgaaggtatgaatgaaccaagaaaagttggtgatccagctgaatggactggtggtgatcaagaaggttggaattttgttaatgaaatgaacgctttgttcgttaaaactattagagctactggtggtaacaatgctaatagacatttgatgattccaacttatgctgcttctgttaatgatggttctattaacaattttaagtacccaaatggtgatgataaagttattgtttctttgcattcttactctccatacaattttgctttgaacaatggtccaggtgctatttctaatttctacgatggtaacgaaattgattgggttatgaacactattaactcttcattcatttctaagggtattccagttattattggtgaatttgttgctatgaacagagataatgaagatgatagagaaagatggcaagaatactacattaaaaaggctactgctttgggtattccatgtgttatttgggataatggttattttgaaggtgaaggtgaaagatttggtattattgatagaaagtctttgaacgttattttcccaaagttgattaatggtttgatgaaaggtttgggtgatgaaaaaccaaaaactactattagaagaactactactactacagttcaagttcaaccaactattaacaacgaatgtttctctactagattgggttattcttgttgtaatggtttcgatgttttgtacactgataatgatggtcaatggggtgttgaaaatggtaattggtgtggtattaaatcttcttgtggtaacaatcaaagacaatgttggtctgaaagattaggttatccatgttgtcaatacactactaatgctgaatatacagacaacgacggtagatggggtgtagaaaacggtaactggtgcggaatatacttgtaa

SEQ ID NO: 253 - DNA, 1220 bp, Irpex lacteus
ttaattaaaatgaagtctttgttgttgtctgctgctgctactttggctttatctactccagctttttctgtttctgtttggggtcaatgtggtggtattggttttactggttctactacttgtgatgctggtacttcttgtgttcatttgaacgattactactttcaatgtcaaccaggtgctgctacttctactgttcaaccaactactactgcttcttctacttcttctgctgcagctccatcttcttcaggtaatgctgtttgttctggtactagaaacaagtttaagttcttcggtgttaatgaatctggtgctgaatttggtaacaatgttattccaggtactttgggtactgattatacttggccatctccatcttctattgattttttcgttggtaagggttttaatactttcagagttccatttttgatggaaagattgtctccacctgctactggtttgactggtccatttgattctacttatttgcaaggtttgaaaactattgtttcttacattactggtaaaggtggttatgctttggttgatccacataactttatgatttacaacggtgctactatttctgatactaatgcttttcaaacttggtggcaaaatttggctgctcaatttaagactgattctcatgttgttttcgatgttatgaatgaaccacatgatattccagctcaaactgtttttaacttgaaccaagctgctattaatagaattagagcttctggtgctacttctcaatctattttggttgaaggtacttcttatactggtgcttggacttggactactacttctggtaattctcaagtttttggtgctattcatgatccaaacaacaatgttgctattgaaatgcatcaatacttggattctgatggttctggtacttctccaacttgtgtttctccaactattggtgctgaaagattgcaagctgctactcaatggttgcaacaaaacaatttgaaaggtttcttgggtgaaattggtgctggttctaatgctgattgtatttctgctgttcaaggtgctttgtgtgaaatgcaacaatctgatgtttggttgggtgctttgtggtgggctgctggtccatggtggggtgattattttcaatctattgaaccaccatctggtgttgctgtttcttctattttgccacaagctttggaaccatttttgttataaggcgcgcc

SEQ ID NO: 254 - DNA, 1155 bp, Chaetomium globosum
atgaagtcctctattttggctggtgtttttgctactggtgctgttgctcaatctggtgcttggggtcaatgtggtggtaatggttggcaaggtgctactacttgtgtttctggttatcattgtgcttatcaaaatgattggtactctcaatgtttgccaggtggtgcttctactactttgagaacttctactactacttcttctgctccagctgctacttctacatctccagctaaaggtaaattcaagtggtttggtattaatcaatcttgtgccgaatttggtactccaacttatccaggtatttggggtaaacattttacttttccatctacctcttctattcaaaccttgattaacgatggttacaatacttttagagttgctttctctatggaaagattggttccagatcaattgacttctacaacttttgatgctggttacttgagaaatttgactgaaaccgttgatttcattactaatgctggtgcttatgctgttttagatccacataattacggaaggtactacggtgatattatcactgatacaaacgcttttaagactttttggactaatttggctactaagttcgtttctaactctagagttgtttttgataccaacaacgaatacaatactatggatcaaactttggttttgaatttgaaccaagctgctattaatggtattagagctgctggtgctactcaacatatttttgttgaaggtaatgcttggtctggtgcatggtcttggaatactactaataccaatatggttgctttgactgatccacaaggtaaattggtttacgaaatgcatcaatacttggatactgattcttctggtacttctccagattgtgtttctgctgaaattggtgttcaaagagttgttggagctactaattggttgagagctaatggtaagattggtattattggtgaatatgccggtggcccaaatactgtttgtcaaactgctgttactaatttgttggaacatttgaaggctaattctgatgtatggcagggtgcattgtggtgggccggtggtccttggtggggtgattacatgtattcttttgaaccaccatctggtactggttatactaattacaactccatcttgaaaaaatacgctccataa

SEQ ID NO: 255 - DNA, 1251 bp, Aspergillus niger
atgagaatctccaacttgattgttgctgcttctgctgcatctatggtttctgctttgccatctagacaaatgaaaaagagggattctggttttaaatgggttggtacttctgaatctggtgctgaatttggttctgctttaccaggtactttgggtactgattatacttggccagaaacttctaaaattcaagtcttgagaaacaagggtatgaacatttttagaatcccattcttgatggaaagattaactccagatggtttgacttcttcttttgcttctacttacttgtctgatttgaagtctactgttgaatttgttactaattctggtgcttatgctgttttagatccacataattacggtagattcgatggttctattattacttctacctctgattttaagacttggtggaaaaatgttgctactgaatttgctgataacgataaggttattttcgataccaacaacgaatatcatgatatggaacaatctttggttttggatttgaatcaagctgctattaatggtattagagctgctggtgctactactcaatacattttcgttgaaggtaatgcttatactggtgcttgggattggactacttacaatgataatttgtctggtttgactgattctgaagataagatcatttacgaaatgcatcaatacttggattctgattcttctggtacatctgaaacttgtgtttcttctactattggtcaagaaagattggaaaaagctactgaatggttgaaaactaacaacaagcaaggtattgttggtgaatttgccggtggtgttaattctgtttgtgaagaagctgttgaaggcatgttggcttatatgtctgaaaattccgatgtttgggttggtgcttcttggtggtctgctggtccatggtggggtacttacatgtattctttggaaccaactgatggtactgcttattctacttatttgccaatcttggaaaaatactttccatctggtgatgcttcagcttcttcttctgcatctgtttctgttgctgctgctacttctactgcttctactactacagctgcttttgaacaaactactactccagctactcaaggtccatctgctactaattctgctggtgaagttaatcaatattaccaatgcggtggtattaattggactggtccaactgtttgtgcttctccatatacttgtaaggttcaaaacgattactattaccaatgtgttgctgagtaa

SEQ ID NO: 256 - DNA, 1236 bp, Penicillium decumbens
atgagatcctcccataaaagaaatttggctgctttgttgtctatttctggtgctgctgttgctcaacaaactgcttggggtcaatgtggtggtcaaggttggtctggtgctacttcttgtgtttctggttatacttgttcttacactaatgattggtactctcaatgtgttccaggttcttctggtggtggtggttctaatccaactactactactacaatgattagaactactacaactgcttcttcttctggtccaactggtggtgccggtggtggtaaagttagatttgctggtgttaatattgctggttttgatttcggtgttgttatttcaggtactcaagatatgacacaaattgttgatgaatctgttgatggtgttaatcaaatgagacacttcgttaatgatgatggtttcaacatttttagattgccatctggttggcaatttttggttaacaacaatttgggtggttctttggattctaacaatttcgctaagtacgataaattggttcaaggttgtttgtctttgggtgcttattgtattgttgatgttcataattacgctagatggaatggtggtgttattggtcaaggtggtccaactgatgatcaatttacttctttgtggacacaattggctactcattacaaatctgaatccaagattattttcggtgttatgaatgaaccacatgatttggatattaacagatgggctactactgttcaaaaagctgttactgctattagaaaagctggtgctacatctcaaatgattttgttgccaggtactgattttacttctgctgctaattttgttgaaaatggttctggtgcagctttgtctgctgttactaatttggatggttctactaccaatttgattttcgatgttcacaaatacttggattctgataattctggtactcatgctgaatgtgttacaaacaatgctgatgcttttaattctttggctcaatggttgagaactaacaaaagacaagcaatgttgactgaaactggtggtggtaatgttcaatcttgtggtacttatatgtgtcaacaattggatgttttgaaccaaaattccgatgtttatttgggttggacttcttggtctgccggtggttttcaagtttcttggaattacgttttgggtgaagttccaactaacaatgttgatacctacttggttaagcaatgttttgttccaaagtggaagaattaa

SEQ ID NO: 257 - DNA, 705 bp, Trichoderma reesei
atgaagttcttgcaagttttgccagctttgattccagctgctttggctcaaacttcttgtgatcaatgggctacttttactggtaatggttacactgtttctaacaatttgtggggtgcttctgctggttctggttttggttgtgttactgctgtttctttgtctggtggtgcttcttggcatgctgattggcaatggtctggtggtcaaaacaatgttaagtcttaccaaaactctcaaattgctattccacaaaagagaaccgttaactctatttcttctatgccaactactgcttcttggtcttattctggttctaatattagagctaacgttgcttatgatttgtttactgctgctaatccaaatcatgttacttattccggtgattacgaattgatgatttggttaggtaagtatggtgatattggtccaattggttcttctcaaggtactgttaatgttggtggtcaatcttggactttgtattatggttacaatggtgctatgcaagtttattctttcgttgctcaaactaacactactaattactctggtgatgttaaaaacttcttcaactacttgagagataacaaaggttacaatgctgctggtcaatacgttttgtcttaccaatttggtactgaaccatttactggttctggtactttgaatgttgcttcttggactgcttctattaactaa

SEQ ID NO: 258 - DNA, 714 bp, Phanerochaete chrysosporium
atgttcaaggctttgttggctgttggttttgctattgctttgacttttgcttctgctgctcaaactattactggtcaatacgattgtattccagctggtgcttatactttgtgtcaaaatttgtggggtgaatatgctggtgttggttctcaaaattctactttgatttctactaatggtaatgctgttacttggcaaactaattggacttgggctaacaatccaaatactgttaaatcttgtgcttctcattcttttccaattgcttcatctgctccaactgcttggaattggacttacgttactgaatctcaaggtattagagctgatgtttcttacgatatttggtttggtaaagctcaatctggtaatccagctacttctgcttcttcttacgaaattatgatttggttgtctggtttgggtggtattcaaccagttggtcatcaaattttgtccggtttgaatattgctggtcatacttggaatttgtggtctggtccaaattctaattggcaagttttctctttcgttatttcttctggtgaagttagaaatttttccgctgacttgaatgaatttttccaatacttgattcaatctcaaggtgttgcttctactcaatatttgcaagctattcaagttggtactgaaccatttgttggttctgcttcattgttgactgaatcttttgctgttgctgttaacgtttaa

SEQ ID NO: 259 - DNA, 705 bp, Stachybotrys echinata
atgaaaaccttcgctattttgggtgcttttttttcttctgctttggctcaaactttgtgtgatcaatatgctacttactctaatggcagatacactgttaacaacaatttgtggggtatgagttctggttctggttctcaatgtacttacgttgattctatttctaattctggtgttgcttggcatactacttggacttggtctggtggtgataatcaagttaaatcttacgctaactctcaagtttctttgactaagaagttggtttctcaaatttcttctattccaactactgttcaatggtcttacgataacactaatactagagctgatgttgcttatgatttgtttactgctgctgatccaaatcatgttacttattccggtgattacgaattgatgatttggttggcaagatatggtaatgttcaaccaattggttctcaaattgcctctgttaatattggtggtcataattgggaattgtggtatggtggttctactcaaaaaacttactctttcgtttctgctactccaattacttctttttctggtaacgttatggatttttggaattacttgactagaaatcatggttatccagcttcatctcaatacttgatcaacatgcaatttggtactgaaccatttactggtggtccagctactttgagagtttctcaatggactgcttctgttaactaa

SEQ ID NO: 260 - DNA, 705 bp, Neosartorya fischeri
atgaaaaccttcgctattttgggtgcttttttttcttctgctttggctcaaactttgtgtgatcaatatgctacttactctaatggcagatacactgttaacaacaatttgtggggtaaatcttctggttctggttctcaatgtacttacgttgattctatttctaattctggtgttgcttggcatactacttggacttggtctggtggtgataatcaagttaaatcttacgctaactctcaagtttctttgactaagaagttggtttctcaaatttcttctattccaactactgttcaatggtcttacgataacactaatactagagctgatgttgcttatgatttgtttactgctgctgatattaatcatgttacctactctggtgattatgaattgatgatttggttggcaagatatggttctgttcaaccaattggttctcaaattgattctgttaacattggtggtcatacttgggaattgtggtatggtggttctactcaaaaaacttactctttcgtttctgctactccaattacttctttttctggtgatgttatggatttttgggattacttgacttctagacatggttatccagcttcatctcaatacttgatcaacatgcaatttggtactgaaccatttactggtggtccagctactttgagagtttctcaatggactgcttctgttaactaa

SEQ ID NO: 261 - DNA, 745 bp, Chaetomium brasiliense
aatgaagttgaccttggttttgtttgtttcttctttggctgctgctactccattgggttggagagaaagaaggcaacaagtttctttgtgtggtcaatcttcttcttggtctggtaatggttatcaattgaacaacaatttatggggtcaatctagagctacttctggttctcaatgtacttatttggattcttcttctaactctggtattcattggcatactacttggacttgggaaggtggtgaaggtgaagttaaatcttatgcttactctggtagacaagtttctactggtttgactattgcttctattgattctatgcaaacttctgtttcttgggaatacaacactactgatattcaagctaatgttgcttacgatattttcactgctgaagatccagatcatgaacattcttcaggtgattacgaagttatgatttggttggcaagatataacaatgtttctccaattggttcttctgttgctactgctactgttggtggtgatacttgggatttgtttgctggtgctaatggtgatatggaagtttattctttcgttgctgaaaatactatgaactctttctctggtgatgttaaagatttcttcgactacttggaacaaaatgttggttttccagttgatgatcaatacttgttggtttttgaattgggttctgaagcttttactggtggtccagctactttgtctgtttctcaattctctgctaacattgcttaa

SEQ ID NO: 262 - DNA, 1053 bp, Chaetomium globosum
atgtctaaggcttctgctttgttggctactttgactggtgctgctttggttgctgctcatggtcatgtttctcatattattgttaacggtgtttactacgaaaattacgatccaactactcattggtatcaaccaaatccaccaactgttattggttggaaagctgctcaacaagataatggttttgttgaaccaaacaattttggtacttctgatatcatttgtcataagtctggttctccaggtggtggtcatgctactgttgctgctggtgataagatttctattgtttgggatccagaatggccagaatctcatattggtccagttattgattatttggctgcttgtaatggtgattgtgaaactgttgataaagcttctttgagattctttaagattgatggtgctggttatgataaaactgctggtagatgggctgctgatactttgagagctaatggtaattcttggttggttcaaattccagctgatttgaaagctggtaattacgttttgagacatgaaattattgctttgcatggtgcttcatctccaaatggtgctcaagcttatccacaatgtattaacttgagagttactggttctggtactaatgctccatctggtgttgctggtacttctttgtatagagcttctgatgctggtattttgtttaatccatacgttgcttctccaaattatccagttccaggtccagctttgattgctggtgctgcatcttctgttgctcaatctaaatctgttgctactgctacagcttctgctactttgccaggtaacaacaatggtggtggtccaaatccacaaccaactactgctactactactgctaatccaggtgtttctactactttgagaacttctacttctacttcaacatctgctcaagttactccaccaccaactggtggtaatgctcaaactaaatatggtcaatgtggtggttctggttggactggtccaactgcttgtgctgctggttcttcttgttctgttttgaatgattggtatgctcaatgtgtttaatga

SEQ ID NO: 263 - DNA, 1125 bp, Aspergillus fumigatus
atgtctgttccaaaaattgctgctgctttgttatcttctgctgctttggttgctggtcatggttttgttactggtgctgttgttgatggtaaatactatactggttacttggttaatcaatacccatatatgtcatctccaccagattctattggttggtctgaaactgctactgatttgggttttgttgatggttctggttattcttctggtgatatcatttgtcataaggatgctaaaaatggtgctatttctgctgaaattaaagctggtggtaaggttgaatttcaatggactgaatggccagaatctcatcatggtccagttattacttatatggctaactgtaatggtgattgtgcttctgttgataaaactactttggaattcttcaagattgatgaatctggtttgatttctgattctaatgttccaggtacttgggcttctgataatttgattgctaacaacaattcttggactgttactgttccatcttctattgctgctggtaattatgttatgagacatgaaattattgctttgcattctgctggtaatcaaaatggtgctcaaaattacccacaatgtattaacttgaaagttactggtggtggttctgataaaccagctggtactttgggtactgctttgtacaaaaatactgatgctggtattttggttaacatttaccaatctttgtcatcttatgaaattccaggtccagctttgtattctggtgcttcttctggttcttctaacaatggtggttctgcttcttcatctgctactgctccatctgctactattactcaaccatctactgctgttccaacttcttctgctacagcttatcaaccatcaactactactgaagctgttactgttacttctattccagctcaacaatcttatgttcaagcaccaactgctactccatcttctacagctggttcttcaggttctggttcaggttcttcttcttctggtactttgccatcttcttctaatttgactgaatacttcaattctttgtctgctgaagaatttttgaaggttttgaagcaaactttttcttggttggttactgaaaaagttcatgctagagatttgtctgcataatga

SEQ ID NO: 264 - DNA, 963 bp, Humicola insolens
atgagaccattttctttggttgctttggctactgctgtttctggtcatgctatttttcaaagagtttctgttaacggcgttgatcaaggtcaattgaaaggtgttagagcaccatcttctaattacccaattgaaaacgttaatcatccagattttgcttgtaacactaacattagacatagagatggtactgttattaagattccagctggtgctactgttggtgcttggtggcaacatgaaattggtggtccatcttttccaggtgatccagataatccaattgctgcttctcataaaggtccaattcaagtttatttggctaaggttgataatgctgctactgcttctccaaatggtttgagatggtttaagattgctgaaaaaggtttgtctggtggtgtttgggctgttgatgaaatgattagaaacaatggttggcattactttactatgccacaatgtattgctccaggtcattatttgatgagagttgaattgttggctttgcattctgcttcatttccaggtggtgctcaattttacatggaatgtgctcaaattgaagttactggttctggtaatttttctccatctgaaactgtttcttttcctggtgcttatccagctaatcatccaggtattgttgtttcaatttacgatgctcaaggtaatgctaacaatggtggtagagaatatcaaattccaggtccaagaccaattacttgttctggtggtggttctaacaacggtggtggcaacaacaatggaggcggaaacaacaacggcggtggaggtaacaacaatggcggtggcaacaacaatggcggaggtaatactggtggtggtagtgctccattgtggggtcaatgtggtggtaatggttattctggtccaactacttgtgctgaaggtacttgtaaaaagcaaaacgattggtattctcaatgtactccataatga

SEQ ID NO: 265 - DNA, 1152 bp, Neosartorya fischeri
atgtctcaaactaagtctttgtctttgttggctgttttgttgtctgctactagagttgctgctcatggtcatgttactaatgttgttgttaacggtgtttcttatgctggtttcgatattaactcttacccatatatgtctgatccaccaaaagttgctgcttggactactccaaatactggtaatggttttattgctccatctgcttataattctccagatatcatttgtcatcaaaacgctactaatgctcaagcttacattgaaattgctgctggtgatagaattcaattgcaatggactgcttggccagaatctcatcatggtccagttattgatatgttggcttcttgtggtgaatcttgtactactgttgataagacttctttgaagttctttaagattgatggtgttggtttggttgataattctgctgttccaggtacttggggtgatgatcaattgattgctaattctaactcttggatggttgaaattccaaaatctattgctccaggtaattatgttttgagacatgaattgattgctttgcatggtgcttttgaagaaggtggagcacaaaattatccacaatgtttcaacttgaaagttactggttctggtactgattctccagctggtactttgggtactgaattgtatactgaatctgatccaggtttgttggttgatatctacaagtctattgcttcttatgctgttcctggtccagctatgtattctggtgctgtttctattactcaaactacttctgctattacttctactggtactgctactgttggttctggtgcagattctactccagttccatcatctgctgcttcatctaaatattctactattgctgttcaagttccaactactaaagctcaatatacacctgttccttcatcttctccatctacttttgttacttctcctgctccttcaacaccagtaccttcatcatcttcagttccagttacttcttctactgctgctccacaaccaactccagctccaggtggtactcaaactgcttatggtcaatgtggtggtagaaattggactggtccaactgcttgtgcttctggttctacttgtaaaacttggaatccatactattctcaatgtgttccaaattaatga

SEQ ID NO: 266 - DNA, 984 bp, Thielavia terrestris
atgaagtctttcactattgctgctttggctgctttatgggctcaagaagctgctgctcacgctacttttcaagatttgtggattgatggtgttgattatggttctcaatgtgttagattgccagcttctaattctccagttactaatgttgcttctgatgatattagatgtaacgttggtacttctagaccaactgttaaatgtccagttaaagctggttctactgttactattgaaatgcatcaacaaccaggtgatagatcttgtgctaatgaagctattggtggtgatcattatggtccagttatggtttacatgtctaaagttgatgatgctgttactgctgatggttcttctggttggtttaaggtttttcaagattcttgggctaaaaatccatctggttctacaggtgatgatgattattggggtactaaggatttgaattcttgttgtggtaagatgaatgttaagattccagaagatattgaaccaggcgattatttgttgagagctgaagttattgctttgcatgttgctgcttcatctggtggtgctcaattttacatgtcttgttaccaattgactgttactggttctggttctgctactccatctactgttaattttccaggtgcttattctgcttctgatccaggtattttgattaacattcatgctccaatgtctacttatgttgttccaggtccaactgtttatgctggtggttctactaaatctgctggttcttcttgttctggttgtgaagctacttgtactgttggttctggtccatctgctactttgactcaaccaacttctactgctactgctacttctgctccaggtggtggtggttctggttgtactgctgctaaatatcaacaatgtggtggtactggttatacaggttgtactacttgtgcttctggttcaacttgttctgctgtttctccaccatattattctcaatgtttgtaatga

SEQ ID NO: 267 - DNA, 681 bp, Chrysosporium lucknowense
atgcatttgtctgctactactggttttttggctttgccagctttggctttggctcaattgtctggttctggtcaaactactagatattgggattgttgtaaaccatcttgtgcttggccaggtaaaggtccatcttctccagttcaagcttgtgataagaatgataacccattgaatgatggtggttctactagatctggttgtgatgctggtggttctgcttatatgtgttcttctcaatctccatgggctgtttctgatgaattgtcttatggttgggctgctgttaaattggctggttcttctgaatcacaatggtgttgtgcttgttatgaattgacttttacttctggtccagttgctggtaaaaagatgattgttcaagctactaatactggtggtgatttgggtgataatcatttcgatttggctattccaggtggtggtgttggtattttcaatgcttgtactgatcaatatggtgctccaccaaatggttggggtgatagatatggtggtattcattctaaagaagaatgcgaatcttttccagaagctttgaaaccaggttgtaattggagatttgattggtttcaaaatgctgataatccatctgttacttttcaagaagttgcttgtccatctgaattgacttctaaatctggttgttctagataatga

SEQ ID NO: 268 - DNA, 930 bp, Chaetomium globosum
atgagatctactccaattttgagaactgctttggctgctgctttgccattggttgcttatgctgctgatggtaaatctactagatattgggattgttgtaaaccatcttgttcttggccaggtaaagctttggttaatcaaccagtttatgcttgttctgctaactttcaaagaattactgattctaatgctaaatctggttgtgatggtggttctgctttttcttgtgctgatcaaactccatgggctttgaatgatgattttgcttatggttttgctgctacttctttggctggtggttctgaagcttcttggtgttgttcttgttacgaattgacttttacttctggtccagttgctggtaaaaagatggttgttcaatctacttctactggtggtgatttgggttctaatcatttcgatttgaatattccaggtggtggtgttggtatttttgatggttgttctccacaatttggtggtttgggtggtcaaagatatggtggtgtttcttctagatctgaatgtgatgcttttccagaagctttgaaaccaggttgttattggagatttgattggtttaagaatgctgataatccaaatttcactttcagacaagttcaatctttgccaaaaccatcttcttcatcttctccagttgctgttccaaaaccaacttctactccaggttcagttccaaaacctacatcaacacctggttctgctccagaacctgctactccaacttctgctgttccatctgttaaaacttcagcttctgcttctccatctaaatcttcatctccagtttcttgtgttactgaaaaatatggtcaatgtggtggtaatggttttactggttgtaaaacttgtacttgtggtactacttgtaaaaagcaaaacgattggtattctcaatgtttgtaatga

SEQ ID NO: 269 - DNA, 951 bp, Acremonium thermophilum
atgagatcttctccatttttgagagctgctttggctgctgctttgccattgtctgctcatgctttggatggtaaatctactagatattgggattgttgtaaaccatcttgtggttgggctggtaaagcttctgttaatcaaccagttttttcttgttctgctgattggcaaagaatttctgattttaacgctaaatctggttgtgatggtggttctgcttattcttgtgctgatcaaactccatgggctgttaatgataatttctcttacggttttgctgctactgctattgctggtggttctgaatcttcttggtgttgtgcttgttatgctttgacttttaattctggtccagttgctggtaaaactatggttgttcaatctacttctactggtggtgatttgggttctaatcaattcgatttggctattccaggtggtggtgttggtattttcaatggttgtgcttctcaatttggtggtttgccaggtgctcaatatggtggtatttctgatagatctcaatgttcttcttttcctgctcctttgcaaccaggttgccagtggagatttgattggtttcaaaatgctgataatccaacttttactttccaaagggttcaatgtccatctgaattgacttctagaactggttgtaaaagagatgacgacgcttcttacccagtttttaatccaccatctgttccaggtttggatggttctaatccaggtaatccaactactactgttgttccaccagcttctacttctacatctagaccaacatcttctacttcatctccagtttctactccaactggtcaaccaggtggttgtactactcaaaaatggggtcaatgtggtggtattggttatactggttgtactaattgtgttgctggtactacttgtactcaattgaatccatggtattctcaatgtttgtaatga

SEQ ID NO: 270 - DNA, 921 bp, Humicola insolens
atgagatcttctccattgttgccatctgctgttgttgctgctttgccagttttggctttggctgctgatggtagatctactagatattgggattgttgtaaaccatcttgtggttgggctaaaaaagctcctgttaatcaaccagttttttcttgtaatgctaacttccaaagaattactgattttgatgctaaatctggttgtgaaccaggtggtgttgcttattcttgtgctgatcaaactccatgggctgttaatgatgattttgctttgggttttgctgctacttctattgctggttctaatgaagctggttggtgttgtgcttgttatgaattgacttttacttctggtccagttgctggtaaaaagatggttgttcaatctacttctactggtggtgatttgggttctaatcatttcgatttgaatattccaggtggtggtgttggtatttttgatggttgtactccacaatttggtggtttgccaggtcaaagatatggtggtatttcttctagaaacgaatgtgatagatttccagatgctttgaaaccaggttgttattggagatttgattggtttaagaatgctgataatccatctttttcattcagacaagttcaatgtccagctgaattggttgctagaactggttgtagaagaaatgatgatggtaattttccagctgttcaaattccatcttcttctacatcttctccagttaaccaacctacttctacttctacaacttctacttcaactacatcttcaccaccagttcaaccaactactccatctggttgtactgctgaaagatgggctcaatgtggtggtaatggttggtctggttgtacaacttgtgttgctggttcaacttgtactaagattaacgattggtatcatcaatgtttgtaatga

SEQ ID NO: 271 - DNA, 903 bp, Thielavia terrestris
atgagatctactccagttttgagaactactttggctgctgctttgccattggttgcttcagctgcttctggttctggtcaatctactagatattgggattgttgtaaaccatcttgtgcttggccaggtaaagctgctgtttctcaaccagtttatgcttgtgatgctaattttcaaagattgtctgatttcaatgttcaatctggttgtaatggtggatctgcttattcttgtgctgatcaaactccatgggctgttaatgataatttggcttatggttttgctgctacttctattgctggtggttctgaatcttcttggtgttgtgcttgttatgctttgacttttacttctggtccagttgctggtaaaactatggttgttcaatctacttctactggtggtgatttgggttctaatcaattcgatattgctatgccaggtggtggtgttggtattttcaatggttgttcttctcaatttggtggtttgccaggtgctcaatatggtggtatttcttctagagatcaatgtgattcttttccagctcctttgaaaccaggttgtcagtggagatttgattggtttcaaaatgctgataatccaacttttactttccaacaagttcaatgtccagctgaaattgttgctagatcaggttgtaaaagaaacgatgattcttcttttcctgtttttactccaccatcaggtggtaatggtggtactggtactccaacttctactgctccaggttcaggtcaaacttcacctggtggtggttctggttgtacatctcaaaaatgggctcaatgcggtggtattggtttttctggttgtactacttgtgtttctggtactacttgtcaaaaattgaacgattactactctcaatgtttgtaatga

SEQ ID NO: 272 - DNA, 1191 bp, Chrysosporium lucknowense
atgaagttcgttcaatctgctactttggcttttgctgctactgctttggctgctccatctagaactactccacaaaaaccaagacaagcttctgctggttgtgcttctgctgttactttggatgcttctactaatgttttccaacaatacactttgcatccaaacaatttttacagagctgaagttgaagctgctgctgaagctatttctgattctgctttagctgaaaaagctagaaaagttgctgatgttggtacttttttgtggttggatactattgaaaacattggtagattggaaccagctttggaagatgttccatgtgaaaatattgttggtttggttatctatgatttgccaggtagagattgtgctgctaaagcttctaatggtgaattgaaagttggtgaattggatagatacaagactgaatacattgataagattgctgaaattttgaaggctcattctaatactgctttcgctttggttattgaaccagattctttgccaaatttggttacaaattctgatttgcaaacttgtcaacaatctgcttctggttatagagaaggtgttgcttatgctttgaagcaattgaatttgccaaatgttgttatgtatattgatgctggtcatggtggttggttgggttgggatgctaatttgaaaccaggtgctcaagaattggcttctgtttacaaatctgctggttctccatctcaagttagaggtatttctacaaatgttgctggttggaatgcttgggatcaagaaccaggtgaattttctgatgcttcagatgctcaatataacaagtgtcaaaacgaaaagatttacattaatactttcggtgctgaattgaaatctgcaggtatgccaaatcatgctattattgatactggtagaaatggtgttactggtttgagagatgaatggggtgattggtgtaatgttaatggtgctggttttggtgttagaccaactgctaatactggtgatgaattggctgatgcttttgtttgggttaaaccaggtggtgaatctgatggtacttctgattcttctgctgctagatatgattctttttgtggtaaaccagatgcttttaaaccatctccagaagctggtacttggaatcaagcttactttgaaatgttgttgaagaatgctaatccatctttttaatga

SEQ ID NO: 273 - DNA, 1155 bp, Magnaporthe grisea
atgttgttctcttctgttttgttgggtttgactgctactgctggtgtttctgctatgccaagaaatagaggttcttcaccaagacatattagaagacaagaaggtgctaatccatttgaaggtaagaagttgtttgctaatccagaatgggctgaaaaagctgaaccagctttggctcattatgaatctattggtgattctgctaatgctgctagagttagaaaagttcaacaaactggtacttttgtttgggtttctaacattgcttctttgccaaatattgatgctgctattgaaggtgctagagctgctaaagaagctactggcgaagatcaaattgttggtttggttcattacaatttgccagatagagattgttctgctggtgaatcagctggtgaattggattctactaaagatggtttgagattgtacaaagaaacttacgttgctccatttgctgaaaaattggctgctgctactgatttgacttttgctgttgttttggaaccagattctttggctaatttggttactaatatgggtgttgaattttgtgctagagcagctccagtttatgaagaaggtattgctcacgctattaagtctttgcaattcgatcatgttcatttgtatttggatgctgctcatggtggttggttgggttgggatgataatttggctccaactgctaaagaatttgctaaagttgttgctatggctggtggtaattctactgttagaggtgttgttactaatgtttctaactacaacccattcattatgccagaaccattggaaccatatactgaatggtctaactcttatgatgaatctcattacgctttgtctttggctccacatttggaagctgaaggtttgccatctagatttttgattgatcaaggtagagttcatttgccaggtgctagagaagaatggggtgaatggtgtaatgttgaacctgctggttttggtattgctccaggtactccaactgaaaatccacatgttgattctattgtttgggttaaaccaggtggtgaatctgatggtgaatgtggtatggaaggtgctactagagctggtgcttggtttgaagaatacttcagaatgttggttgaaaatgctcatccatctttggattcttaatga

SEQ ID NO: 274 - DNA, 1269 bp, Chaetomium globosum
atgagatctttcactttgttggctggtttgttggctactgcttctgctttgccagctattgaacctagacaatctggtaatccattttctggtagaactttgttggttaatccatcttattctgaatctttggaacaaactagacaagctttggctaatgctggtgatcaaacttctgctggtaaagttaagtttgttcaagataaggttggtacttttgtttggatttctaacattgctttgttggcagatattgataaggctattactaatgctagagctgctaaagctaaaggtgaaaatccagttattggtttggttttgtacaatattccagatagagattgttctgctggtgaatcttctggtgaattgtcttttgctcaaaatggtttggctagatacaaatctgaatacgttactccatttgctcaaaaattgaaagctgcttctgatttgcaatttgctgttgttttggaaccagatgctatgggtaatatggttactggtactactgctttttgtcaaaatgctagaggtccacaacaagatggtattgcttatgctattcaacaattgcaagcttctaatgttgctttgtatttggatgttgctaatggtggttggttgggttggccagataatttggaattgactgctgatgttgttgctactattttgcaaaaagctggtggtaacaatagaattagaggttatgcttctaacgtttctaattacaacccatacaaatctgctaatccaccagcttatactgaaggttctccatctccagatgaatctagatatgctgataatttggctgctgcttttggtcaaagaggtttgccaactaagttcattattgatcaaggtagagttgctttggatggtgctagaaaagaatggggtgaatggtgtaatgtttatccatctggttttggtcaaccatttactactaatactggtaacaacaacgttgatgctattgtttggattaaaccaggtggtgaatctgatggtcaatgtggtatgccaggtgctccaagagctggtgcttggtttgatgcttttgctcaacaattggctaaaaatgctcatccagatattactgctggtggtggtaacaacggtggaggtggcaatcctggcggtggtaattgtgctgctagatgggctcaatgtggtggtcaaggttttactggtccaacttgttgttctgaaggtacttgtactgtttctaatcaatggtactctcaatgtttgtaatga

SEQ ID NO: 275 - DNA, 1101 bp, Humicola insolens
atggctaagaagttgtttattactgctgctttggctgctgctgttttggctcaatctggtaatccattttctggtagaactttgttggttaactctgattactcttctaaattggatcaaactagacaagcttttttgtctagaggtgatcaaactaatgctgctaaagttaagtacgttcaagaaaaggttggtactttttactggatttctaacattttcttgttgagagatattgatgttgctattcaaaatgctagagctgctaaagctagaggtgaaaatccaattgttggtttggttttgtataatttgccagatagagattgttctgctggtgaatcttctggtgaattgaagttgtctcaaaatggtttgaatagatacaagaacgaatacgttaatccatttgctcaaaaattgaaagctgcttctgatgttcaatttgctgttattttggaaccagatgctattggtaatatggttactggtacttctgctttttgtagaaatgctagaggtccacaacaagaagctattggttacgctatttctcaattgcaagcttctcatattcatttgtacttggatgttgctaatggtggttggttgggttgggctgataaattggaaccaactgctcaagaagttgctactattttgcaaaaagctggtaacaatgctaaaattagaggtttctcttctaatgtttctaattacaacccatactctacttctaatccaccaccatatacatctggttctccatctccagatgaatctagatacgctactaatattgctaatgctatgagacaaagaggtttgccaactcaattcattattgatcaatctagagttgctttgtctggtgctagatctgaatggggtcaatggtgtaatgttaatccagctggttttggtcaaccatttactactaatacaaacaacccaaacgttgatgctattgtttgggttaaaccaggtggtgaatctgatggtcaatgtggtatgggtggtgctccagctgctggtatgtggtttgatgcttatgctcaaatgttgactcaaaatgctcatgatgaaattgctagataatga

SEQ ID NO: 276 - DNA, 1155 bp, Neurospera crassa
atgagagctttgtctttgttggctgctttgtctgctgctggtgctactgttactgcttctccagttggtccagctcatgctccaagagctttatctgattctaatccatttgttggtaagaagttgtttgctaatccaaaatgggcttctaaattggaagatacttacaaggcttttacttctagaggtgattctgaaaatgctgctgttgttagaaaagttcaaaagattggttcttttgtttgggtttcttctagatctggtttgtctgaaattgatgaagctattcaagctgctagagctgaacaatctagaactggtcaaaaacaaattgttggtttggttatgtacaatattccagatagagattgttctgctggtgaatcagctggtgaattgtctactaaaaacgatggtttgagaatttacaaagaacaattcgttaaaccatatgctgctaaattggctgctgctaaagatttgcaatttgctgttgttgttgaaccagattctttgggtaattctgttactaattctgctgttgaattttgtaaacaagctattccaacttatagagaaggtattgcttttgctattaagtctttgcaattggataatgttgctgtttatttggatgctgctaatggtggttggttgggttggggtgattctttgccaaaagctgctgatgaaattgctactattttgtctatggcttctccagctaaagttagaggtttctctactaatgtttctaattacaacccatacttggctactaaaagagattctttcacttctggttctccatcttatgatgaatctcattacgcttcatctttggctccatatttgcaacaacatggtttgccagctcatttcattattgatcaaggtagagttgcttatccaggtgctagaaaagattggggtgattggtgtaatgttaatccagctggttttggtcatattccaactactgatcaatctgttttgcaaaactctaacgttgatgctattgtttggattaaaccaggtggtgaatctgatggtcaatgtggtttgaaaggtgctccaattgctggtgcttggtttggtggttatgctgaaatgttgactggtaatgctgatgcttctgttaagaattcttaatga

SEQ ID NO: 277 - DNA, 1125 bp, Streptomyces avermitilis
atgcgaccgtcaccgccccatgcccgcagcgcgcgtggcctgttcggtgccctgctcactgcgctcgtctcgctggccgcgttgctgaccaccgcctcggtggcgcaggccgacaccagcatctgcgaaccgttcgggtcaacgacgatccagggccgctacgtcgtccagaacaaccgctggggcaccagcgaggcccagtgcatcaccgccaccgactcgggattcaggatcacccaggccgacggctcggtacccacgaacggcgccccgaagtcctacccgtccgtctacaacggctgccactacaccaattgctcgcccggcacgagccttccggcccagctcagtaccgtctccagcgcgccgaccagcatctcctacagctatgtcagcaacgcgatgtacgacgccgcgtacgacatctggctcgaccccacgccccgcaccgacggcgtcaaccggaccgagatcatggtctggttcaacaaggtcggatccgttcagcccgtgggctcgcaggtcggcacggccaccgtggccgggcgccagtggcaggtgtggtccggcaacaacggctcgaacgacgtgctgtccttcgtggcgccgtcggcgatcaccagctggagcttcgacgtcatggacttcgtccggcaggccgtttcccgcgggctggcgcagaacagctggtacctgaccagcgttcaggcgggcttcgagccctggcagaacggcgccggcctcgccgtgacctcgttctcctccacggtcaacaccggcggcggcaaccccggtgaccccggcagccccacagcctgcaaggtggcctacgcgacgaacgtctggcagggcggcttcaccgccgacgtcaccgtcaccaacaccggttcctcccccgtcaacggctggaagctggcgttcaccctgcccgccggacagcagatcaccagcagctggagcgccggcgtctccccgtcatcgggagcggtcacggcaagcagcctcgcgtacaacgcgcagatcgcgaccggcggccgggtgtccttcggcttccagggcagctactccggcaccttcgccgcgcccgccggcttcagcctgaacggcgccgcctgcaccaccgcc

SEQ ID NO: 278 - DNA, 1476 bp, Streptomyces avermitilis
atgcgacatccccctcgttcagcacttcttcttgtcgccggcgcggtcgccctcatcgggagcgcggtcgtgccggtcgtcacggcgtcgggagccacgacgcccgcgtgcacggtggagtacgccgtcaccagccagtgggacgccggcttccagggcggcgtgaagatcaccaacaacatggccgccctgagcagttggcgtctcacgttcgacttcgccggcgggcagaaggtcacccagggctggaacgccaagtggtcccagtccggtaccaccgtgaccgcggccaacgagagctacaacggctcgctgggctccggtgcgagtgtcagcgccgggttcctcgcctcgtggtcggggagcaacgccgtaccgacgtcgttcaagctcaacgggacgacgtgcaatgtggaggcggaaccgtcgccttcaccgtcaccgtcggacccgccggcgacgggtgcggcgccgaaactgcacgtatccgggaacaagctcgtggacgccgacggcaagacgcgccggctgctcggcgtcaaccgttccggcggcgagttcatgtgtgtccagggctacggcatcttcgacgggccggtcgacgacgccgccgtcaaggcgatcgccgactggaaggccaacaccgtccgcattccgctgaacgaggagtgctggctcggcctgtccaacatcaagccggagtacggcggcgccaactacatcgcggccgtcaaggacctggtggccagggtggaggcgcacggcatgacgccggtcgtcgaactgcactggacgtacggccagtacaccggcaactccgccggctgttcggacgtgcacgccacctgccagaagccgatgccggacgcccagtacacgccgtccttctgggcctcggtggcgagcaccttcaaggacgacgcggcggtcgcgttcgacctgttcaacgagccctacccggaccgcgccacctccacgaccacccaggcgtggcagtgctggcgggacggcgggacctgccccggcatcacctacgaggtggccggcatgcaggacctggtcgacgcggtgcgcggcaccggcgccaagaacctgatcctggcgggcgggctcgcgtactcgaacgacctgagccagtggctgacgtacaagcccaccgatgccacgggcaatctcgtcgccgcgtaccacgtctacaacttcaatacctgcgccagtgagacgtgctggaactcgacgctcgccccggtggccgcccaagtcccgctggtggccggggagatcggcgagaacacctgctcccactccttcatcgacaccgtcatgaagtggttcgacgaccggggcctctcctacctcggctggacctggaacacctgggactgctcctccggtccctccctgatctccaactacgacggcactcccacgtcgttcggtatcggactgcgcgaccacctgcgcgccctcaacgga

SEQ ID NO: 279 - DNA, 2646 bp, Streptomyces avermitilis
atgcgaagaacccgcatcttcacggccgtgctcgcgctggcggccggtctgcccgccggcaccccgccggcactggccgcgagcgcccccacggcgacgatcgccgcggacacgtacagctggaagaacgcccgcgtcgacggcggcggcttcgtccccggcatcgtcttcaaccgctccgagaagaacctcgcctacgcccgcaccgacatcggcggcgcctaccgctgggccgagtcctcgaagacctggacgccgctgctcgactcggtcggctggagcgactgggggcacacgggtgtcgtgagcctcgcctccgactccgtcgacccgaacaaggtgtacgcggccgtcggcacgtacacgaacagctgggacccgggcaacggtgccgtgctcaggtccggcgaccggggcgcgagctggcagaagaccgacctgcccttcaagctgggcgggaacatgccgggccggggcatgggcgagcggctcgcggtcgacccgaacaggaacagcgtgctgtatctcggcgcgcccagcggcaaggggctgtggcggtcgacggactcgggggcctcctggtcgcaggtcaccgacttcccgaacgtcggcacctacgtgcaggacgcgaccgacacgagcgggtacgcgtccgacaaccagggcatcgtgtgggtcaccttcgacgagtcgacggggtcgccggggagctccacgcggacggtgtacgtcggggtcgccgacaaggacaactccgtctatcgctccacggacgcgggcgcgacctggtcccggctggccggccagcccaccggccatctcgcccacaagggcgtgctggacgcggcgaacggctgtctgtacctcgcgtacagcgacaagggcggaccgtacgacggcggcaagggacagctgtggcggtacacgacgaagaccgggacctggacgaacatcagcccggtcgcggaggccgacacctactacggcttcagcgggctgaccgtggaccggcagcatccggggacggtgatggcgactgcgtacagctcctggtggccggacacgcagctcttccgctccacggacagcggcggcacctggacgaaggcctgggactacacctcgtatccgagccgctcgaaccgcttcaccatggatgtctcgtcctcgccctggctcacctggggagcgaaccccgcaccgcccgagcagaccccgaaactcggctggatgaccgagtccctggagatcgacccgttcgactccgcgcgcatgatgtacggaacgggcgcgacggtctacggcacggacaacctgacgaactgggacagcggaagccagttcaccatcaagccgatggcgcggggcctggaggagacggccgtcaacgacctcgcctcgcctccctccggcggcgcccagctgttcagcgcgctcggtgacatcggcggcttccggcacacggacctcaccacggtgccgtcgctgatgtacacgtcgccgaacttcaccacgagcaccagcctcgactacgccgagaccgacccgggcacggtggtgcgggtcggcaatctcgactcgggtccgcatgtggcgttctcgacggacaacggcgccaactggttcgcgggggcggacccttcgggggtcagcgggggtgggacggtcgcggccgcgtccgacggcagtcgcttcgtgtggagcccggcgggcaccggggtgcagtacacgaccgggttcggcacctcgtggtcggcgtccgcgggcctcccggccggggcgatcgtcgagtccgaccgggtcgacccgaagaccttctacggcttcaagtccggcaggttctacgtcagttcggacggcggggcgaccttcacggcgtccgcggccacgggcctgccgagcggcgacagcgtgcgcttcaaggcgctgcccggcacgaagggcgacatctggctggcgggcggcgcgagcgacggcgcgtacgggctgtggcactcgacggacggcggcgcggccttcaccaagctcgccaccgtcgaccaggccgacaccatcggcttcggcaaggcggcgaccggcgcctcgtaccagacgctctacaccagcgcgaagatcggcggtgtgcgcggcatcttccggtcgaccgacaagggcgcgagctggacccgcgtcaacgacgatgcccaccagtggggttggacgggcgcggcgatcaccggtgaccccagggtctacgggcgcgtgtatgtgtcgacgaacgggcgcgggatcgtctacggcgacaccgcgggctcttcggacggcggcggtacggagccggcaccgacgggcgcctgcacggtgacatacaggatcacgaaccagtggtcgggcggcttccaggccgatgtacagctcgccaacaccgggtcgaccgcctgggacggctggtcgctgggctggtcgttcggtgacgggcaggaggtcacccagctgtggaacgcctcgtacgcgcaggccggttcgggggtgaccgcagcgaacctggcctggaacgggagggtggcggccgggtcctcggtgagcttcgggttcacgggaagctggtcgggatccaatggcagaccgaccgccttcaaactcggcggtcagaactgcacggtcgcc

SEQ ID NO: 280 - DNA, 807 bp, Streptomyces avermitilis
atgcagcatcgcagaccgcgcctgtccaagaaggcgagggccctggtcgccaccacggtcgtcctcgcggccgccgccggcgtcaccgtcgcccaggcgggcgagaccggcaagaagtgcgcggccttcgacacgatcacgctcggcaagtactacgtgaacaacaacctctggggccaggacaaggccaccggcacccagtgcgtctgggacgactcccggtccggctccacgatctcctggggcacggactactcctgggccaacaactccgccgggcacgactacgacgtgaagtcctacgcgagcagtgtcctcggctggcactggggctggaaggcggacaaggcggcgacgggtctgcccgtccgggtgggcgaccgcaagagcgtgaggaccacctgggacttctcggtcggcgccggtcccggcacgatgaacgtcgcgtacgacctgtggctgcacgccaagaacaacgcggactggcaggaccagcccaccgacgagatcatggtctggctcaaccgccagggcggcgcgggcccgctgggcaccaagtacggcagcgtcagcctcggcggcgcgatgtgggacatctaccagggcgacatcggctggaaggtgtactccttcgtacggcgtacgaacaccaccaaggccacgctcgacctggacgacttcacccaggccctggtccgccgcaagctgctgagcgacgacaagtacgtctccggcatcgaggcgggcaccgaggtcttcaagggcgcgggccgactggacaccaaggcgtactcggtggacatcggc

SEQ ID NO: 281 - DNA, 1014 bp, Streptomyces avermitilis
atgtacgggaagaggggggccggggcactggcggccgtggcgttggcgggggccgcgctgctgctggcggggtgttccgctcccgaggacaacagcaagaagggcggcgggggcgctgacatcgcgcagcggccgaaaggctcggacccgttctgggtcaaccccgaggggaacgcggccgagcagctcgccacctacgcgagagcgggcaggaaggacgacgccgagcaaatccggaagatagcggagcagccgacgggggagtggatcgggccggagaacccggaagcggaggcgcgcggttacacggaggccgcggagaaggcggaccgcaccgcgctcctcgtcctctacaacattccgcaccgcgactgcgggcagttctcgcagggcggcgccgcggacggcgacgcgtaccgggcctggatcgacggcgtgaccaagggcatcggggaccggaacacgacggtggtcctggagccggacgcgctgctgcacatcgtcgacggctgcacgccggacgagttccacgaggagcgctacgacctgctcaagggcgcgatcgccaagctcggagcgctgaagaacaccaaggtctacctggacgcgggcaacgcgggctggggccaccccgaccagatcttccagccgctccagcgggcgggcgtcgaccgggccgacggcttcgcggtcaacgtctccaacttctacacgacgcgggactccatcgcgtacggcaagcagctgtcggcgaaggtcggcgacaagcacttcgtgatcgacacgagccgcaacggcaacgggccgtacacggcgggcaaggcggacgagaactggtgcaacccgccggggcgggcgctgggcgagaccccgtccacgaagacggccgatccgctggtggacgcgtatgtgtgggtcaaacgcccgggcgagtcggacggcacgtgcaagggcggcccgaaggcgggcgagtggtggtccgactatgcgctgaagctggcccgcgcgtccaag

SEQ ID NO: 282 - DNA, 1110 bp, Streptomyces avermitilis
atggtggcggtggcctcgttcgtggtcgccgtcggcaccgcgacggggatgatgtcggcgttcgacgacggccgtacgcccgaccaggcccgcccgcaagtgaccggcccgcccagccgccggccgctgcccgccgtcccgtccccgtcgcccgccacgacgtccgcgaggccgagtccggccaccccgtcggccgggcccggcccgaagtcctccccgagcaagagggagccgaccactgcggccgcccccgcccagctctatcgccaccccgaatcccaggtcctcgactgggtcggcgcgcatccggacgacgcccggcgcgcggtcatcgagtcccgcatcgccgaccggcccgccgcggtctggttcgccgacttcgctccgtcgaccatcaccgcccgggtcagggcggtcacggcggccgccgccgcgcaggaccgggtcccggtcgtcgtgccgtacacgatcccggaccgcgactgcggcggggcgtcgcagggcggcgcgcccgatctcgccgcttacgacgcctggatcgacaagttcgccgccgggctcggctccggcgaggtcatcgtcatactggagcccgactcggtcgcccagtccgactgtctgtccgaggggcggcaggccgaccgcttcgcctcgctggctcgcgcgggccgggtcctcaaggccgcgaaccccggggtccgggtctacttcgacggcgggcactccgagtggaatccggccgccaaacaggcctcgctgctcgaccaggcgggcgccgcctcgcccgccgcctccgacggcatcttcacgaacgtgtccaacttccaccgtacgagcgacgagatcgcgtacgcccggcaggtgctggccggcctcggcggccccgcgagcctgggcgccgtcatcgacaccagccgcaacggcaacggcgcgccggccggcggcgagtggtgcgatccggcgggccggaagatcggccgggcgccgaccctgacgaccggggaggccgggatcgacgcctacctgtgggtgaagctgccgggcgagtccgacgggtgcaagggcacgcccgggaccttctcgcccgcctacgcctatgaactggcgcgc

SEQ ID NO: 283 - DNA, 1497 bp, Bacillus subtilis
atgaaacggtcaatctctatttttattacgtgtttattgattacgttattgacaatgggcggcatgatagcttcgccggcatcagcagcagggacaaaaacgccagtagccaagaatggccagcttagcataaaaggtacacagctcgttaaccgagacggtaaagcggtacagctgaaggggatcagttcacacggattgcaatggtatggagaatatgtcaataaagacagcttaaaatggctgagagatgattggggtatcaccgttttccgtgcagcgatgtatacggcagatggcggttatattgacaacccgtccgtgaaaaataaagtaaaagaagcggttgaagcggcaaaagagcttgggatatatgtcatcattgactggcatatcttaaatgacggtaatccaaaccaaaataaagagaaggcaaaagaattcttcaaggaaatgtcaagcctttacggaaacacgccaaacgtcatttatgaaattgcaaacgaaccaaacggtgatgtgaactggaagcgtgatattaaaccatatgcggaagaagtgatttcagttatccgcaaaaatgatccagacaacatcatcattgtcggaaccggtacatggagccaggatgtgaatgatgctgccgatgaccagctaaaagatgcaaacgttatgtacgcacttcatttttatgccggcacacacggccaatttttacgggataaagcaaactatgcactcagcaaaggagcacctatttttgtgacagagtggggaacaagcgacgcgtctggcaatggcggtgtattccttgatcaatcgagggaatggctgaaatatctcgacagcaagaccattagctgggtgaactggaatctttctgataagcaggaatcatcctcagctttaaagccgggggcatctaaaacaggcggctggcggttgtcagatttatctgcttcaggaacattcgttagagaaaacattctcggcaccaaagattcgacgaaggacattcctgaaacgccatcaaaagataaacccacacaggaaaatggtatttctgtacagtacagagcaggggatgggagtatgaacagcaaccaaatccgtccgcagcttcaaataaaaaataacggcaataccacggttgatttaaaagatgtcactgcccgttactggtataaagcgaaaaacaaaggccaaaactttgactgtgactacgcgcagattggatgcggcaatgtgacacacaagtttgtgacgttgcataaaccaaagcaaggtgcagatacctatctggaacttggatttaaaaacggaacgttggcaccgggagcaagcacagggaatattcagctccgtcttcacaatgatgactggagcaattatgcacaaagcggcgattattcctttttcaaatcaaatacgtttaaaacaacgaaaaaaatcacattatatgatcaaggaaaactgatttggggaacagaaccaaat

SEQ ID NO: 284 - DNA, 1143 bp, Clostridium phytofermentans; identical to SEQ ID NO: 29

SEQ ID NO: 285 - DNA, 1323 bp, Thermobifida fusca
atgtcccccagacctcttcgcgctcttctgggcgccgcggcggcggccttggtcagcgcggctgctctggccttcccgtcgcaagcggcggccaatgattctccgttctacgtcaaccccaacatgtcctccgccgaatgggtgcggaacaaccccaacgacccgcgtaccccggtaatccgcgaccggatcgccagcgtgccgcagggcacctggttcgcccaccacaaccccgggcagatcaccggccaggtcgacgcgctcatgagcgccgcccaggccgccggcaagatcccgatcctggtcgtgtacaacgccccgggccgcgactgcggcaaccacagcagcggcggcgcccccagtcacagcgcctaccggtcctggatcgacgaattcgctgccggactgaagaaccgtcccgcctacatcatcgtcgaaccggacctgatctcgctgatgtcgagctgcatgcagcacgtccagcaggaagtcctggagacgatggcgtacgcgggcaaggccctcaaggccgggtcctcgcaggcgcggatctacttcgacgccggccactccgcgtggcactcgcccgcacagatggcttcctggctccagcaggccgacatctccaacagcgcgcacggtatcgccaccaacacctccaactaccggtggaccgctgacgaggtcgcctacgccaaggcggtgctctcggccatcggcaacccgtccctgcgcgcggtcatcgacaccagccgcaacggcaacggccccgccggtaacgagtggtgcgaccccagcggacgcgccatcggcacgcccagcaccaccaacaccggcgacccgatgatcgacgccttcctgtggatcaagctgccgggtgaggccgacggctgcatcgccggcgccggccagttcgtcccgcaggcggcctacgagatggcgatcgccgcgggcggcaccaaccccaacccgaaccccaacccgacgcccacccccactccgacccccacgccgcctcccggctcctcgggggcgtgcacggcgacgtacacgatcgccaacgagtggaacgacggcttccaggcgaccgtgacggtcaccgcgaaccagaacatcaccggctggaccgtgacgtggaccttcaccgacggccagaccatcaccaacgcctggaacgccgacgtgtccaccagcggctcctcggtgaccgcgcggaacgtcggccacaacggaacgctctcccagggagcctccacagagttcggcttcgtcggctctaagggcaactccaactctgttccgacccttacctgcgccgccagc

SEQ ID NO: 286 - DNA, 1848 bp, Thermobifida fusca
atgacccccctgacgcgacgactgcgtgccggagcagccgcgatcgcgatcggagcgtctgctcttatccccctgacttcctcccccgcagccgcctcaggcaccgctgactggctgcacacggacggcaaccggatcgtggactccgcgggcaacgaggtgtggctcaccggagccaactggttcggcttcaacaccagcgaacggatgttccacgggctgtgggccgccaacatcgaggacatcaccagtgcgatggccgagcgcggcatcaacatggtgcgtgtccccatcagcacccaactgctgttggagtggaagaacggccaggccggaccgagtggagtcaacgagtacgtcaaccccgaactggcggggatgaacaccctcgaagtgttcgactactggctgcaactgtgcgaagagtacggcctcaaagtcatgcttgacgtgcacagcgcggaggccgacaactccgggcactactacccggtctggtacaagggcgatatcaccaccgaggacttctacacggcctgggagtgggtcaccgagcggtacaagaacaacgacaccatcgtcgccgcagacatcaagaacgagccccacggcaaagccaacgagaccccgcgcgccaagtgggacggctccacggacatcgacaacttcaagcacgtctgcgagaccgccggtaagcgcatcctcgcgatcaacccgaacatgctcatcctgtgcgaggggatcgagatctaccccaaggatgggcaggactggtcctccaccgatgggcgggactactactccacctggtggggcggcaacctgcgcggcgtcgccgaccaccccgtcgacctgggcgcccaccaggaccagttggtctactcgccgcacgactacggtcccagcgtgttcgagcagccctggttcgaaggcgagtggaaccggcagaccctgaccgaggacgtgtggcgtcccaactggctctacatccacgaagacgacatcgctccgctgctcatcggcgagtggggcggcttcctggatgggggcgacaacgagaagtggatgacggcgctgcgctcgctcatcatcgacgagaagatgcaccacaccttctgggcgctgaacccgaactcgggtgacaccggcggcctgctcaactacgactggacaacctgggacgaggccaagtacgcgttcctcaagcctgcgttgtggcaggacgccaacggcaagttcgtcggcctggaccacgatgtgccgctgggcggggtgggctccaccaccggtgtgtcgctgaaccagtactacggcgggggcggaccgagccagccgcccacggaacccacggagccgccgacggagcccacggagccgccgacggagccgacggagccgcccgccaaccccacgggtgcgctcgaggtctactaccgcaacaacagtcttgcggccgacgacagccagatcgcgccggggctgcgtctggtcaacaccggaagcagcacggtcgacctggctgacgtggaaatccactactacttcaccaacgagcccggcggtaccctccagttcacctgcgactgggctcaagtgggctgcgccaacgtcaacgcgtccttcacgtcgctgtcggctccgggcgccgacacctccctggtgctcaccctcagcggcagcctcgctcccggggcgagcaccgagctccaaggccggatccacaccgcgaactgggcgaacttcgacgaaagcgacgactacagccgcggcaccaacactgactgggagctcagcgaggtgatcaccgcatacctcggcggcaccctggtctggggtacgcctcccgcc

SEQ ID NO: 287 - DNA, 5133 bp, Anaerocellum thermophilum
ggatcatttaattatggtgaagcattacaaaaagctataatgttttacgagtttcagatgtctggcaagttgcctaactgggtaagaaacaactggaggggagatagcgcattgaaagacggtcaagataatggcttagaccttactggaggttggtttgatgctggcgatcatgttaagtttaatttgccaatgagttatactggaacgatgttatcatgggcagtgtacgaatataaagacgcttttgtcaaaagcggtcagcttgagcacattttgaatcaaatagagtgggtaaatgattactttgtgaagtgtcacccgtctaaatatgtctactactaccaggttggcgatggaagtaaagatcatgcatggtggggtcctgctgaagtaatgcaaatggaaagaccatcatttaaggttacacagtctagcccgggcagtactgtagtgacagaaacggcagcttcattagcagctgcatctattgttcttaaagacaggaatcctactaaggctgcaacatatttgcaacatgctaaagaattatatgagtttgcagaagtcacaaaaagcgatgctggatatacggcagcaaatggttattataactcatggagtggcttttacgatgaactttcttgggctgcagtatggttgtatttagctactaatgacagcacataccttacgaaggcagagtcatatgttcaaaattggccaaaaataagtggatctaacactattgattacaaatgggctcattgctgggatgacgtgcacaatggtgcagctttattgcttgcaaagataacaggcaaagatatttataaacagataatagaaagccatttagattattggattacgggatacaatggtgaaagaataaagtatactcctaaaggattggcttggcttgaccaatggggctcattaaggtacgcaacaacaacggcttttttggcatttgtatatagtgattgggttggttgtccatctactaagaaagagatttatagaaaatttggagagagccagatagattacgctcttggctcagctggtagatcttttgtcgtaggatttggcacaaacccgcctaagaggccacatcacagaactgctcattcaagttgggcagacagccaatctattccttcatatcacaggcacactttatacggtgctttggtgggaggcccaggtagtgatgatagctatacagacgatatatctaattacgttaataacgaagtagcatgcgattataatgcaggatttgtcggcgctcttgcaaaaatgtatcagttatacggtggaaatccgatacctgactttaaagctattgaaacgccaactaatgatgaattttttgtggaagcaggcataaacgcttcaggaacaaattttattgagataaaggcaattgttaataaccaaagtggttggcctgctaaagcaacggataaattgaagtttagatattttgtagaccttagcgaattaataaaagctggatactctccaaatcagttaactttgtcaacaaattataaccaaggcgcaaaggttagtggtccgtacgtatgggatgctagcaaaaatatttattatatacttgtcgattttacgggaactttaatataccctggcggtcaagacaaatataagaaagaggtgcagtttagaattgcagctccacaaaatgttcagtgggataactctaatgactactcatttcaggatataaagggagtcagtagcggctctgtagtgaaaacaaaatatattcctttgtacgacggtgacgttaaggtctggggagatggcccgggtacatctggagctacgccgactccaacagcaacggcaacgcctactccgacacctactgttactcctacgccgacacctacgccgacttctactgcaactccgacgcctacgcctactccaacggtgacaccgactcctacgccaacgcctactgcaacaccgacaagcacgccaacaccaacttctacgccatcaagcacaccggttgctggcggacagattaaagtcttgtacgcaaataaggagactaattctacaacgaacacgattaggccatggttaaaagtggtcaatacaggatcatcttcaatagacttatctagggtaacgattagatactggtatacggttgacggcgataaagcacaaagcgctatatctgactgggcacagattggtgcaagtaacgttacgtttaaatttgtaaagttatcatctagtgtttctggagcagattattaccttgaaataggctttaaaagcggagcaggacagttacaagctggaaaggatacgggcgagattcaaataaggtttaataaaagcgattggtctaattataaccaaggaaacgactggtcatggatgcagagcatgacaaactatggcgaaaatgtgaaagtaactgcttatattgatggagtattagtgtggggacaagaaccaagcggtgctacacctacgccaactgctacgcctgcaccgacagtaactcctacgccgacaccaacaccgacgagtacacctacggcaactccgactgctacgccgacaccaactccaacgccgagctctactcctgtggcaggcggtcaaataaaggtactttatgctaacaaagaaacgaacagcactacaaatacaataagaccgtggcttaaggtcgtaaacactggcagttcaagtattgatttgagcagagttacaataaggtattggtacacagtggatggagacaaggctcagtcagcaataagcgattgggctcaaataggcgcttcaaatgtgacgtttaaatttgtaaaattgagtagttcagtcagcggcgctgactactatttagagattggatttaagtctggtgctggtcaacttcaggctggtaaagacactggtgaaatacagattagatttaacaagtcagattggagtaactataatcaaggaaatgattggagttggatgcagtctatgacgaattacggagagaacgtaaaggttacagcatacatagacggcgtgcttgtatggggtcaggaaccttcaggtgcaactccgactccaacagcaacgccggctcctacggttacaccgactcctacgccgactcctacgtcaacgccgactgctacacctacagcaacaccaacgcctactcctacaccttcttcaacgcctagcgttgtaggtgaatacggacagagatttatgtggttgtggaataaaattcacgatccggctaacggctattttaatcaagatggtataccatatcactctgtcgagactcttatttgtgaaagacctgactacggacacttaacaacatcagaagcatttagttattacgtgtggttggaggctgtttacggcaagttgacgggtgattggagcaaatttaaaactgcatgggatacattagaaaagtacatgataccgtctgctgaggaccaaccaatgaggtcatacgatcctaataaaccagcaacttacgctggagagtgggaaacacctgataaatacccgagtccattggaatttaacgtacctgtaggtaaggacccacttcataatgagttagttagcacgtatggatctactttgatgtacggcatgcactggcttatggatgtagataattggtatggttacggaaaaagaggcgacggtgtctcaagggcaagttttattaacacatttcagagaggacctgaagaaagcgtgtgggagacagttccgcatccatcttgggaagaatttaagtggggcggtcctaatggatttttagatttatttataaaagatcaaaattattcaaaacagtggagatatacggacgcacctgatgctgatgcaagggctattcaagcaacttactgggctaaggtatgggcaaaagagcagggcaaatttaatgaaataagtagctacgtggctaaggcagctagaatgggtgactacttgaggtacgcaatgtttgataaatattttaaaccacttggatgccaagataagaacgctgcaggcggtacaggatacgactctgctcactatttactttcatggtactacgcatggggcggtgctttagacggagcatggagttggaaaataggaagctctcacgttcattttggctaccagaatcctatggctgcatgggcattggctaacgattcagatatgaagccgaaaagtccaaacggtgcaagcgattgggctaaatctcttaagagacaaattgagttttatagatggttacaatcagcagaaggagctatagcaggcggtgctacgaatagttggaatggaaggtatgaaaaataccctgcaggcactgctacattttatggtatggcatacgagccaaaccctgtatatcacgatccgggaagcaatacgtggtttggctttcaggcttggtctatgcaaagagttgtagaatactattatgtcactggtgacaaagatgcaggagctttgcttgaaaagtgggtgtcatgggttaaatcagtagtcaaattaaatagtgatggcacatttgcaattccaagcacattggactggaagaggcagcctgatacgtggaacggtgcttacactggaaattctaatcttcatgtgaaagttgtagattatggcacagacttaggtataacggcatcattggcaaacgctcttttatactatagtgcaggaactaagaaatacggcgtctttgatgagggtgctaaaaatttggcaaaggaacttttagatagaatgtggaaattgtatagggacgaaaaaggacttagcgctccggagaagagggcagattataaaagattttttgaacaagaagtgtacattccagctggctggataggtaagatgcctaatggagatgttataaaatctggcgtaaaatttattgacataaggtcaaagtataaacaggatccagattggcctaaattagaggcagcttacaagagtggtcaagcaccggaatttagatatcatagattttgggctcagtgtgacattgcaatagctaacgcaacatatgaaattttgtttggaaatcaa

SEQ ID NO: 288 - DNA, 1428 bp, Chaetomium globosum
atgttgtctccagctttggcttcttctttgttggttgttttgggtgctgctggtgctcatgctcaacaaagacaagctttgtggggtcaatgtggtggttctggttggaatggtccaactgcttgtgttgatggtgcttactgttttcaacaaaatcaatggtatcatcaatgtattccaggttctgatagatctccatctccaactaatccaccacaacaatcttctactttgactacttctagagttactgttgctccaccaacttctacttctccagctccaggtggtggtggtactacttgtccagctactccatctggtcaaggttctccagttgctaatgctttgaatgatccattcacttttcatggtggtggtaaagtttcttctaaagctgattggacttgtagacaagctgaaatttctaagttgttgcaacaatatgaattgggtactttgccaccaaaaccatcttcagttactgcttcattttctggttctaccttgtctatttctgtttctgaaggtggtaagtctatttctttctctgtttccattaacaatagaccatcttcttcaggtccacatccagctattattaactttggtacttttggtggtttgccagttccagctggtgttgctactattaacttcaacaacgacgaaattgctcaacaacaagatcaatcttctagaggtaaaggtaaattctatgatatctacggttctggtcattctgctggtgctttgactgcttgggcttggggtgtttctagaattattgatgctttggaattgactagagcccaaactaatattgatccagctagaattggtgttactggttgttctagaaatggtaaaggtgctatggttgctggtgcattggaacctagaattgctttgactttgccagaagaatctggagctggcggttcaggttgttggagaattgctacttggcaaaagaatagaggtgaaaacgttcaagaatctaagcaaatcgttactgaaaatgtttggttttctaccaatttcaactctcaagttaacaatgttaatgctttgccatttgatcatcatatgttggctggtttgattgctccaagagcattatatgttatggaaaacactgatatggaatggttgggtaaagtttcaacttatggttgtatgggtattgctagaaaacaatgggaagctttgggtgctttggattcttttggttattctcaagttggtggtaattctcattgctcttttccatcttctcaacaaggttctgaattgaatgcttttatcggtaaatacttgttgaacaatccaaatgctggtaacactaacatttttagatctaccggtaatcaaaatttcgatttgaactcttggtcaccatggactgttccaaaattgtcttaatga

SEQ ID NO: 289 - protein, 459 aa, Aspergillus fumigatus
MLLQAFLFLLAGFAAKISAQQPAASSAGNPKLTTYKCTTAGGCVAQDTSVVLDWGYHWIHTVDGYTSCTTSSGVDSTLCPDAATCAKNCVIEPANYTSAGVTTSGDSLTMYQYVQSNGVYTNASPRLYLLGPDKNYVMLKLLGQELTFDVDLSTLPCGENGALYLSEMSATGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYMQNGKVIANAVSSTGVNSITEDWCTSVDGSAATFGGLTTMGKALGRGMVLIFSIWNDASGFMNWLDSGNAGPCSSTEGNPDLIKAQNPTTHVVFSNIRWGDIGSTFKGSDGSVTTTTSTTSTKTTTSTAPGPTQTHYGQCGGQGWTGPTACASPYTCQVLNPWYSQCL

SEQ ID NO: 290 - protein, 468 aa, Neosartorya fischeri
MLLQAFLFLLAGFAAKISAQQPATSSAGNPKLTTYKCTTAGGCVAQDTSVVLDWGSHWIHTVNGYTSCTTSSGVDSTLCPDEATCAKNCVIEPANYTSAGVATSGDSLTMYQYVQNNGVYTNASPRLYLLGPDKDYVMLKLLGQELSFDVDLSTLPCGENGALYLSEMSASGGRNEYNTGGAEYGSGYCDAQCPVIAWKNGTLNTSGASYCCNEMDILEANSRANSYTPHPCSATDCDKGGCGFNPYALGQKSYWGPGGTVDTSKPFTITTQFITNDGTTTGTLSEIRRQYIQNGKVIANAVSSAGVSSITEDWCTSVDSSAATFGGLTTMGKALGRGMVLIFSIWNDASGFMNWLDSGNSGPCSSTEGNPDLIKAQNPTTHVVFSNIRWGDIGSTFKGSDDSGTTTTKTTTTKTSTSTTSTKTTTSTAPGATQTHYGQCGGQGWTGPTACASPYTCKAQNQWYSQCL

SEQ ID NO: 291 - protein, 459 aa, Aspergillus clavatus
MLLQAFLFLLAGFAAKISAQNPGAADAGNPKLTTYKCTTAGGCVKQDTSVVIDWNYHWIHTANGYDSCTTSSGVDSSLCPDAATCARNCVIEPANYTSAGVATSGDTLTMHQYIKSDGEYVNASPRLYLLGSDGDYVMMKLLGQELTFEVDLSTLPCGENGALYLSEMSATGGRNEYNKGGAEYGSGYCDAQCPVQTWKNGTLNTNGSGFCCNEMDILEGNSRANSFTPHPCSSTDCDKGGCGFNPYALGQQNYWGPGGTVDTFKPFTVTTQFITSDGTQTGTLKEIRRQYIQNGKEWCTSGASFGGLTTMGQALGRGMVLAFSIWNDNSQFMNWLDSGSNGPCSSTEGNPDLIKAQNPTTHVVFSNIRWGDIGSTFSNPGGSSSSSTTRIVTITKPTTVFPTSTKTTTIQAPTTTTTASGATQTQWGQCGGQGWSSPTACATPYTCQAQNAWYSQCVL

SEQ ID NO: 292 - protein, 469 aa, Aspergillus terreus
MLLQAFLFLLAGFAAKISAQQPSSSSPGNPSLTTWKCTTGGGCLQQDTSVVLDWGFHWIHTSNSQSCTTSSGVNSALCPDEATCAKNCVIDPANYATAGVATSGDTLTMHQYYQNNGVITNASPRLYLLGSDGNYVMLKLLGQELSFNVDLSTLPCGENGALYLSEMSATGGRNEYNTGGAQYGSGYCDAQSPVMAWRNGTLNTSGQGFGCNEMDILEANSRANSFTPHPCNGNDCDKGGCGFNPYALGQQNYWGPGGTVDTSKPFTITTQFITDDGTKTGTLKEIRRQYIQNGKIIANAKSSAGVDSITEPWCESVDGAAATYGGLKRMGEALGRGMVLIFSIWNDAGGFMNWLDSGSAGPCSSTEGNPSLIQSAHPDTHVVFSNIRWGDIGSTYTNPGGSGSSSSSTTTTTKTTSTTTTTKITTTTSAGGATQTHWGQCGGQGWTGPTACASPYTCQKQNEWYSQCL

SEQ ID NO: 293 - protein, 460 aa, Trichoderma longibrachiatum
MLLQAFLFLLAGFAAKISAQQPGTSTPEVHPKLTTYKCTTSGGCVAQDTSVVLDWNYRWMHDANYNSCTVNGGVNTTLCPDEATCGKNCYIEGVDYAASGVTASGSTLTLNQYMPSSSGGYSSVSPRLYLLGPDGEYVMLKLNGQELSFDVDLSALPCGENGSLYLSQMDENGGANQYNTAGANYGSGYCDAQCPVQTWRNGTLNTSGQGFCCNEMDILEGNSRANALTPHSCTATACDSAGCGFNPYGSGYPNYFGPGDTVDTSKTFTIITQFNTDNGSPSGNLVSITRKYRQNGVDIPSAKPGGDTISSCPSASAYGGLATMGKALSSGMVLVFSIWNDNSQYMNWLDSGRAGPCSSTEGNPSNILANNPGTHVVYSNIRWGDIGSTTNSTGGNPPPPPPPASSTTFSTTRRSSTTSSSPSCTQTHWGQCGGIGYTGCKTCTSGTTCQYGNDYYSQCL

SEQ ID NO: 294 - protein, 493 aa, Penicillium marneffei
MLLQAFLFLLAGFAAKISAQQAPTPDNTVSLPTWKCTSSGGCVQQSTSIVVDWVYHWIHTVNGSTSCTTSSGLNSALCGTEKECYTNCEISPATYDGLGIRASGNALTLNQYVTSNGTTNSVSPRVYLLDPAGKNYEMLQLLGQEISFDVDVSNLPCGENGALYLSEMDATGGRSQYNPAGASYGSGYCDAQCGTGSWFNGSINTGSLGSCCNEMDLWEANSQATALTPHPCSVDGPYGCSGSACGSTGVCDKNGCGFNPYALGDHNYYGSGYTVDTSKPFTVTTQFVTSDGTKTGALTEIRRSYVQNGKVIANAVASSSSGVSGANSITESFCTTMDSEAGTLGGLRTMGEALGRGMVLIFSIWNDAGGSMNWLDSGNSGPCSSTAGVPSTIQANDPSTSVTFSNIKWGDIGSTGPSPGGSSSSSSSSSKSSSTTISITHSTTSSSATTTTTSTGATQTHWGQCGGTGYSGPTACAPPYTCKAQNPYYSQCL

SEQ ID NO: 295 - protein, 395 aa, Chaetomium globosum
MLLQAFLFLLAGFAAKISAQQPGSVTPEVHPKLPTWQCTKSGGCVEQDTSVVLDWNYRWFHTSDNTTSCTTSSGIDSTLCPDAATCAENCVVEGTDYTSSGIETSGSSLTLRQFVKDSEGKTNSVSPRAYLLGADGDYVMFKLLNQELSFDVDVSTLPCGENAALYFSEMDKTGGRNEHNTGGAKYGSGYCDAQCPVQTWNNGTLNTSHQGSCCNEMDILEANSKAEAFTPHPCIGDNCDKGGCGFNSYARGNKNYWAPGGTLDTSKPFTMVTQFITDDGTSSGKLSQIVRSYVQNGQKVASAVSGGDSITVEGCSSSDAYGGLVGMGEALGRGMVLAMSIWNDASGFMNWLDSGDNGPCNETEGDPANILANHPDSQVVLSNIRWGDIDSTVQL

SEQ ID NO: 296 - protein, 440 aa, Neurospora crassa
MLLQAFLFLLAGFAAKISAQQIGTITPESHPKLPTKRCTLSGGCQTVSTSIVLDAFQRPLHKIGDPSTACVVGGPLCPDAATCAANCALEGVDYASLGVKTEGDALTLNQWVSDPSNPGHYKTSSPRTYLVAEDGKNYEAVKLLGKEISFDVDVSNLPCGMNGAFYLSEMLMDGGRGEFNAAGAEYGTGYCDAQCPKLDFINGEANINKTHGACCNEMDIFEANARAKSFTPHPCSIERVYKCTGDTECGQSQGVCDQWGCTYNEYQKGVHDFYGLAPPAKTIDTTQKFTVTTQFLTDNGREDGVLVEIRRLWSQNGKLIKNAKIAVDSLSTDSVSTQFCEKTSSWTMQRGGLKTMGEAMGRGMVLIFSIWADESGFMNWLDSGDSGPCSATEGDPKLILQKKPDARVTFSNIKWGEMGSTYASAGKYGVRRVAKGLSAL

SEQ ID NO: 297 - protein, 419 aa, Aspergillus oryzae
MLLQAFLFLLAGFAAKISAQQVGTTADAHPRLTTYKCTSQNGCTRQNTSLVLDAATHFIHKKGTQTSCTNSNGLDTAICPDKQTCADNCVVDGITDYASYGVQTKNDTLTLQQYLQTGNATKSLSPRVYLLAEDGENYSMLKLLNQEFTFDVDASTLVCGMNGALYLSEMEASGGKSSLNQAGAKYGTGYCDAQCYTTPWINGEGNTESVGSCCQEMDIWEANARATGLTPHPCNTTGLYECSGSGCGDSGVCDKAGCGFNPYGLGAKDYYGYGLKVNTNETFTVVTQFLTNDNTTSGQLSEIRRLYIQNGQVIQNAAVTSGGKTVDSITKDFCSGEGSAFNRLGGLEEMGHALGRGMVLALSIWNDAGSFMQWLDGGSAGPCNATEGNPALIEKLYPDTHVKFSKIRWGDIGSTYRHL

SEQ ID NO: 298 - protein, 456 aa, Thielavia heterothallica
MLLQAFLFLLAGFAAKISAQTPGEGEEVHPQITTYRCTKADGCEEKTNYIVLDALSHPVHQVDNPYNCGDWGQKPNETACPDLESCARNCIMDPVSDYGRHGVSTDGTSLRLKQLVGGNVVSPRVYLLDETKERYEMLKLTGNEFTFDVDATKLPCGMNSALYLSEMDATGARSELNPGGATFGTGYCDAQCYVTPFINGLGNIEGKGACCNEMDIWEANARAQHIAPHPCSKAGPYLCEGAECEFDGVCDKNGCAWNPYRVNVTDYYGEGAEFRVDTTRPFSVVTQFRAGGDAGGGKLESIYRLFVQDGRVIESYVVDKPGLPPTDRMTDEFCAATGAARFTELGAMEAMGDALTRGMVLALSIWWSEGDNMNWLDSGEAGPCDPDEGNPSNIIRVQPDPEVVFSNLRWGEIGSTYESAVDGPVGKGKGKGKGKAPAGDGNGKEKSNGKRFRRFL

SEQ ID NO: 299 - protein, 430 aa, Fusarium oxysporum
MLLQAFLFLLAGFAAKISAQTPDKAKEQHPKLETYRCTKASGCKKQTNYIVADAGIHGIRQKNGAGCGDWGQKPNATACPDEASCAKNCILSGMDSNAYKNAGITTSGNKLRLQQLINNQLVSPRVYLLEENKKKYEMLHLTGTEFSFDVEMEKLPCGMNGALYLSEMPQDGGKSTSRNSKAGAYYGAGYCDAQCYVTPFINGVGNIKGQGVCCNELDIWEANSRATHIAPHPCSKPGLYGCTGDECGSSGICDKAGCGWNHNRINVTDFYGRGKQYKVDSTRKFTVTSQFVANKQGDLIELHRHYIQDNKVIESAVVNISGPPKINFINDKYCAATGANEYMRLGGTKQMGDAMSRGMVLAMSVWWSEGDFMAWLDQGVAGPCDATEGDPKNIVKVQPNPEVTFSNIRIGEIGSTSSVKAPAYPGPHRL

SEQ ID NO: 300 - protein, 422 aa, Humicola insolens
MLLQAFLFLLAGFAAKISAQKPGETKEVHPQLTTFRCTKRGGCKPATNFIVDLSLSHPIHRAEGLGPGGCGDWGNPPPKDVCPDVESCAKNCIMEGIPDYSQYGVTTNGTSLRLQHILPDGRVPSPRVYLLDKTKRRYEMLHLTGFEFTFDVDATKLPCGMNSALYLSEMHPTGAKSKYNPGGAYYGTGYCDAQCFVTPFINGLGNIEGKGSCCNEMDIWEANSRASHVAPHTCNKKGLYLCEGEECAFEGVCDKNGCGWNNYRVNVTDYYGRGEEFKVNTLKPFTVVTQFLANRRGKLEKIHRFYVQDGKVIESFYTNKEGVPYTNMIDDEFCEATGSRKYMELGATQGMGEALTRGMVLAMSIWWDQGGNMEWLDHGEAGPCAKGEGAPSNIVQVEPFPEVTYTNLRWGEIGSTYQELQL

SEQ ID NO: 301 - protein, 495 aa, Pyrenophora tritici-repentis
MLLQAFLFLLAGFAAKISAAVILGWARGYCNRRWDSPKSTSEKKYFGINTVAIYNIESAVQRLPSRPRLHFFKVFSMPRYTFLTAALVGLASAQSLLGTTPEVHPKLKTWKCTKAGGCKAVNSAIVIDAGSHGIRQKNNPSLGCGDFGSTPPKSVCPDKETCAKNCVMDGISDYSALGVTTQGSSLRLDMLNSKGNEASPRVYLLAEDEKNYEMLKLTGNEFTFDVDTSKLPCGMNGALYLSEMAANGGRSKLNPGGATYGTGYCDAQCFVTPWINGEGNVKGQGVCCNEMDIWEANKAATQIAPHTCSKNSIFGCTGDECGASGLCDKNGCGDNPYNQRKSPDYYGPSKKVDTTKPFTVVTQFPAKNGVLQAIVRKYVQNGKVIENAMMNLTMDQAFCTAQGATMYNKLGGHKGMGDALSRGMVLALSIWWDKTGGMNWLDSGAAGPCSATEGFPAEIIKVEPRPTVTFSSIKWGEIGSTFKEQGSTKVPFTAL

SEQ ID NO: 302 - protein, 455 aa, Magnaporthe grisea
MLLQAFLFLLAGFAAKISAQQIGTEIPEIHPELPTQFCTRKDGCVVRKTKIVADVMFRPMHVKDNVSMPCTAAFGTALCPDAATCTRNCVLEGVDYDSLGVATKGNALKLNQYLFNGAEYKKVAPRVYLLGEDDRNYELMKLVNMELAFDVDVSQLGCGMNGALYFSEMDVSGSRSDLNPAGAAYGTGECDAQCFQDQNFTANRMATALTPHTCSKPSSFRCTGEECGKGKAGVCDKSGCQINPYKLGDKKFYGPGGTIDTNKRFTVLTQFVHEHPEAGIDISRAGPLKEIRRKYIQDGRVIEDVHTSNASFSPLKGMDQRFCDTYGSEAYTRLGGIVGTGQSMARGMVLIFSIWNSEGDFMKWLDAGDRGPCGPTDGDPKKIKQETPNVSVTYSNIKWGELGTVLGHDASPGAKGDEAKARLAANSGGATAPAVTGGSVLGLAIVLLALVHLFL

SEQ ID NO: 303 - protein, 434 aa, Fusarium graminearum
MLLQAFLFLLAGFAAKISAQTPDKTQEKHPKIETYRCTKAKGCKKATNYIVADAELHGISQANGQSCGNWGEAANSTACPDEATCAKNCKLFGMNEAAYKAKGISTSGNALRLEMLRNGQSVSPRVYLLEENKNKYEMLKLTGAEFSFDVETQKLPCGMNGALYLSEMPADGGKSTSKYSKVGAAQGGGYCDAQCYVTPFINGVGNIKGKGVCCNEMDIWEANSRATHIAPHPCSVPGLYGCTGAECQKDGICDKAGCGWNHNRNGVPDFYGRGKNFKVDTTRKFTVVSSFPADKSGKLTEMHRHYIQDGKVIKSAVVTLPGPPKVTGNIITDNYCKASHADDYIRLGGTEEMGDAMTRGMVLAMSVWWSEGDSMEWLDGQGAGAGPCTKEEGLPKNIVKVEPNPEVTFSNIRIGEIGSTHAVKMPRVYGAHRL

SEQ ID NO: 304 - protein, 475 aa, Hypocrea jecorina
MVSFTSLLAGVAAISGVLAAPAAEVEPVAVEKREAEAEAQQPGTSTPEVHPKLTTYKCTKSGGCVAQDTSVVLDWNYRWMHDANYNSCTVNGGVNTTLCPDEATCGKNCFIEGVDYAASGVTTSGSSLTMNQYMPSSSGGYSSVSPRLYLLDSDGEYVMLKLNGQELSFDVDLSALPCGENGSLYLSQMDENGGANQYNTAGANYGSGYCDAQCPVQTWRNGTLNTSHQGFCCNEMDILEGNSRANALTPHSCTATACDSAGCGFNPYGSGYKSYYGPGDTVDTSKTFTIITQFNTDNGSPSGNLVSITRKYQQNGVDIPSAQPGGDTISSCPSASAYGGLATMGKALSSGMVLVFSIWNDNSQYMNWLDSGNAGPCSSTEGNPSNILANNPNTHVVFSNIRWGDIGSTTNSTAPPPPPASSTTFSTTRRSSTTSSSPSCTQTHWGQCGGIGYSGCKTCTSGTTCQYSNDYYSQC

SEQ ID NO: 305 - protein, 419 aa, Hypocrea jecorina
MNKSVAPLLLAASILYGGAVAQQTVWGQCGGIGWSGPTNCAPGSACSTLNPYYAQCIPGATTITTSTRPPSGPTTTTRATSTSSSTPPTSSGVRFAGVNIAGFDFGCTTDGTCVTSKVYPPLKNFTGSNNYPDGIGQMQHFVNEDGMTIFRLPVGWQYLVNNNLGGNLDSTSISKYDQLVQGCLSLGAYCIVDIHNYARWNGGIIGQGGPTNAQFTSLWSQLASKYASQSRVWFGIMNEPHDVNINTWAATVQEVVTAIRNAGATSQFISLPGNDWQSAGAFISDGSAAALSQVTNPDGSTTNLIFDVHKYLDSDNSGTHAECTTNNIDGAFSPLATWLRQNNRQAILTETGGGNVQSCIQDMCQQIQYLNQNSDVYLGYVGWGAGSFDSTYVLTETPTSSGNSWTDTSLVSSCLARKL

SEQ ID NO: 306 - protein, 389 aa, Chrysosporium lucknowense
MKSSILASVFATGAVAQSGPWQQCGGIGWQGSTDCVSGYHCVYQNDWYSQCVPGAASTTLQTSTTSRPTATSTAPPSSTTSPSKGKLKWLGSNESGAEFGEGNYPGLWGKHFIFPSTSAIQTLINDGYNIFRIDFSMERLVPNQLTSSFDEGYLRNLTEVVNFVTNAGKYAVLDPHNYGRYYGNVITDTNAFRTFWTNLAKQFASNSLVIFDTNNEYNTMDQTLVLNLNQAAIDGIRAAGATSQYIFVEGNAWSGAWSWNTTNTNMAALTDPQNKIVYEMHQYLDSDSSGTHAECVSSNIGAQRVVGATQWLRANGKLGVLGEFAGGANAVCQQAVTGLLDHLQDNSEVWLGALWWAAGPWWGDYMYSFEPPSGTGYVNYNSILKKYLP

SEQ ID NO: 307 - protein, 417 aa, Polyporus arcularius
MHSFSGLLVAVALAVSVKAQTTLSPVWGQCGGTGWTGPTACATGSVCTKLNDAHFQCVPGTATTAPSSPSTTSSAPAPTSSCQIPAPSAGKLRFAGVNIAGFDFGCSTDGTCSASGAWPPLTQYYGNDGEGQMQHFVKDDGFNVFRLPVGWQYLTDGVLGGTIDEDNFEEYDALVQACLNTGASCIIDIHNYARWNGKIIGQGGPTNEQFAELWSSVAAKYANNSKIIFGVMNEPHDVPDINLWAESVQAAVTAIRKAGATSQIILLPGNNWTSAETFISNGSGAALMKVTNPDGSTTNLVFDVHKYLDSDNSGTHEECVTNNIDNAWAPLAEWLRCNGRQAFNTETGGGNVASCQQFMCEQVAFQNANSDVFLGYVGWAAGNFYQGYALGEVPTYSNGQWVDTSLVSSCLAPNARK

SEQ ID NO: 308 - protein, 521 aa, Aspergillus kawachii
MRISNLIVAASAATMVSALPSRQMKKRDSGFKWVGTSESGAEFGSALPGTLGTDYTWPETSKIQVLRNKGMNIFRIPFLMERLTPDGLTGSFASTYLSDLKSTVEFVTNSGAYAVLDPHNYGRFDGSIIESTSDFKTWWKNVATEFADNDKVIFDTNNEYHDMEQSLVLNLNQAAINGIRAAGATTQYIFVEGNAYTGAWDWTTYNDDLSGLTDSEDKIIYEMHQYLDSDSSGTSETCVSSTIGKERIEKATEWLKTNNKQGIIGEFAGGVNSVCEEAVEGMLAYMSENSDVWVGASWWSAGPWWGTYMYSLEPTDGTAYSTYLPILEKYFPSGDASSSSSASASVAAATSAVSTTTTAAFEQTTTPATQVEIASSSSSSSAVAASQTTLSKVKSKSKSPCKLSSATSSAVSSAAAVTTPAVAATTPAAAPTSSSVAFATTSVYVPTTTAAAPSQVSSSAAASSSGVVGVSDPQGPSATNSAGEVNQYYQCGGINWTGPTVCASPYTCKVQNDYYYQCVAE

SEQ ID NO: 309 - protein, 419 aa, Heterodera schachtii
MHWADVACSRPPWPRDSVKALKCNWNANVIRGAMGVDEGGYLSDANTAYNLMVAVIEAAISNGIYVIVDWHAHNAHPDEAVKFFTRIAQAYGSYLHILYEDFNEPLDVSWTDVLVPYHKKVIAAIRAIDKKNVIILGTPKWSQDVDVASQNPIKDYQNLMYTLHFYASSHFTSDLGAKLKTAVNNGLPVFVTEYGTCEASGNGNLNTDSMSSWWTLLDSLKISYANWAISDKSEACSALSPGTTAVNVGVSSRWTSSGNMVASYYKKKSTGISCSGSSSGSSSGSSSGSSGTSSGSSGSSSGSSSGSSSGSSGSSSGSSSGSGSASISVVPSNTWNGGGRVNFEIKNTGSVPLCGVVFSVSLPSGTTLGGSWNMESAGSGQYSLPSWVRIEAGKSSKDAGLTFNGKDKPTAKIVTTKKC

SEQ ID NO: 310 - protein, 471 aa, Orpinomyces sp.
MKFLNSLSLLGLVIAGCEAMRNISSKELVKELTIGWSLGNTLDASCVETLNYSKDQTASETCWGNVKTTQELYYKLSDLGFNTFRIPTTWSGHFGDAPDYKISDVWMKRVHEVVDYALNTGGYAILNIHHETWNYAFQKNLESAKKILVAIWKQIAAEFGDYDEHLIFEGMNEPRKVGDPAEWTGGDQEGWNFVNEMNALFVKTIRATGGNNANRHLMIPTYAASVNDGSINNFKYPNGDDKVIVSLHSYSPYNFALNNGPGAISNFYDGNEIDWVMNTINSSFISKGIPVIIGEFVAMNRDNEDDRERWQEYYIKKATALGIPCVIWDNGYFEGEGERFGIIDRKSLNVIFPKLINGLMKGLGDEKPKTTIRRTTTTTVQVQPTINNECFSTRLGYSCCNGFDVLYTDNDGQWGVENGNWCGIKSSCGNNQRQCWSERLGYPCCQYTTNAEYTDNDGRWGVENGNWCGIY

SEQ ID NO: 311 - protein, 399 aa, Irpex lacteus
MKSLLLSAAATLALSTPAFSVSVWGQCGGIGFTGSTTCDAGTSCVHLNDYYFQCQPGAATSTVQPTTTASSTSSAAAPSSSGNAVCSGTRNKFKFFGVNESGAEFGNNVIPGTLGTDYTWPSPSSIDFFVGKGFNTFRVPFLMERLSPPATGLTGPFDSTYLQGLKTIVSYITGKGGYALVDPHNFMIYNGATISDTNAFQTWWQNLAAQFKTDSHVVFDVMNEPHDIPAQTVFNLNQAAINRIRASGATSQSILVEGTSYTGAWTWTTTSGNSQVFGAIHDPNNNVAIEMHQYLDSDGSGTSPTCVSPTIGAERLQAATQWLQQNNLKGFLGEIGAGSNADCISAVQGALCEMQQSDVWLGALWWAAGPWWGDYFQSIEPPSGVAVSSILPQALEPFL

SEQ ID NO: 312 - protein, 384 aa, Chaetomium globosum
MKSSILAGVFATGAVAQSGAWGQCGGNGWQGATTCVSGYHCAYQNDWYSQCLPGGASTTLRTSTTTSSAPAATSTSPAKGKFKWFGINQSCAEFGTPTYPGIWGKHFTFPSTSSIQTLINDGYNTFRVAFSMERLVPDQLTSTTFDAGYLRNLTETVDFITNAGAYAVLDPHNYGRYYGDIITDTNAFKTFWTNLATKFVSNSRVVFDTNNEYNTMDQTLVLNLNQAAINGIRAAGATQHIFVEGNAWSGAWSWNTTNTNMVALTDPQGKLVYEMHQYLDTDSSGTSPDCVSAEIGVQRVVGATNWLRANGKIGIIGEYAGGPNTVCQTAVTNLLEHLKANSDVWQGALWWAGGPWWGDYMYSFEPPSGTGYTNYNSILKKYAP

SEQ ID NO: 313 - protein, 416 aa, Aspergillus niger
MRISNLIVAASAASMVSALPSRQMKKRDSGFKWVGTSESGAEFGSALPGTLGTDYTWPETSKIQVLRNKGMNIFRIPFLMERLTPDGLTSSFASTYLSDLKSTVEFVTNSGAYAVLDPHNYGRFDGSIITSTSDFKTWWKNVATEFADNDKVIFDTNNEYHDMEQSLVLDLNQAAINGIRAAGATTQYIFVEGNAYTGAWDWTTYNDNLSGLTDSEDKIIYEMHQYLDSDSSGTSETCVSSTIGQERLEKATEWLKTNNKQGIVGEFAGGVNSVCEEAVEGMLAYMSENSDVWVGASWWSAGPWWGTYMYSLEPTDGTAYSTYLPILEKYFPSGDASASSSASVSVAAATSTASTTTAAFEQTTTPATQGPSATNSAGEVNQYYQCGGINWTGPTVCASPYTCKVQNDYYYQCVAE

SEQ ID NO: 314 - protein, 411 aa, Penicillium decumbens
MRSSHKRNLAALLSISGAAVAQQTAWGQCGGQGWSGATSCVSGYTCSYTNDWYSQCVPGSSGGGGSNPTTTTTMIRTTTTASSSGPTGGAGGGKVRFAGVNIAGFDFGVVISGTQDMTQIVDESVDGVNQMRHFVNDDGFNIFRLPSGWQFLVNNNLGGSLDSNNFAKYDKLVQGCLSLGAYCIVDVHNYARWNGGVIGQGGPTDDQFTSLWTQLATHYKSESKIIFGVMNEPHDLDINRWATTVQKAVTAIRKAGATSQMILLPGTDFTSAANFVENGSGAALSAVTNLDGSTTNLIFDVHKYLDSDNSGTHAECVTNNADAFNSLAQWLRTNKRQAMLTETGGGNVQSCGTYMCQQLDVLNQNSDVYLGWTSWSAGGFQVSWNYVLGEVPTNNVDTYLVKQCFVPKWKN

SEQ ID NO: 315 - protein, 234 aa, Trichoderma reesei
MKFLQVLPALIPAALAQTSCDQWATFTGNGYTVSNNLWGASAGSGFGCVTAVSLSGGASWHADWQWSGGQNNVKSYQNSQIAIPQKRTVNSISSMPTTASWSYSGSNIRANVAYDLFTAANPNHVTYSGDYELMIWLGKYGDIGPIGSSQGTVNVGGQSWTLYYGYNGAMQVYSFVAQTNTTNYSGDVKNFFNYLRDNKGYNAAGQYVLSYQFGTEPFTGSGTLNVASWTASIN

SEQ ID NO: 316 - protein, 237 aa, Phanerochaete chrysosporium
MFKALLAVGFAIALTFASAAQTITGQYDCIPAGAYTLCQNLWGEYAGVGSQNSTLISTNGNAVTWQTNWTWANNPNTVKSCASHSFPIASSAPTAWNWTYVTESQGIRADVSYDIWFGKAQSGNPATSASSYEIMIWLSGLGGIQPVGHQILSGLNIAGHTWNLWSGPNSNWQVFSFVISSGEVRNFSADLNEFFQYLIQSQGVASTQYLQAIQVGTEPFVGSASLLTESFAVAVNV

SEQ ID NO: 317 - protein, 237 aa, Stachybotrys echinata
MKVAALLVALSPLAFAQSLCDQYSYYSSNGYEFNNNMWGRNSGQGNQCTYVDYSSPNGVGWRVNWNWSGGDNNVKSYPYSGRQLPTKRIVSWIGSLPTTVSWNYQGNNLRANVAYDLFTAANPNHPNSSGDYELMIWLGRLGNVYPIGNQVATVNIAGQQWNLYYGYNGAMQVYSFVSPNQLNYFSGNVKDFFTYLQYNRAYPADSQYLITYQFGTEPFTGQNAVFTVSNWSAQQNN

SEQ ID NO: 318 - protein, 234 aa, Neosartorya fischeri
MKTFAILGAFFSSALAQTLCDQYATYSNGRYTVNNNLWGKSSGSGSQCTYVDSISNSGVAWHTTWTWSGGDNQVKSYANSQVSLTKKLVSQISSIPTTVQWSYDNTNTRADVAYDLFTAADINHVTYSGDYELMIWLARYGSVQPIGSQIDSVNIGGHTWELWYGGSTQKTYSFVSATPITSFSGDVMDFWDYLTSRHGYPASSQYLINMQFGTEPFTGGPATLRVSQWTASVN

SEQ ID NO: 319 - protein, 247 aa, Chaetomium brasiliense
MKLTLVLFVSSLAAATPLGWRERRQQVSLCGQSSSWSGNGYQLNNNLWGQSRATSGSQCTYLDSSSNSGIHWHTTWTWEGGEGEVKSYAYSGRQVSTGLTIASIDSMQTSVSWEYNTTDIQANVAYDIFTAEDPDHEHSSGDYEVMIWLARYNNVSPIGSSVATATVGGDTWDLFAGANGDMEVYSFVAENTMNSFSGDVKDFFDYLEQNVGFPVDDQYLLVFELGSEAFTGGPATLSVSQFSANIA

SEQ ID NO: 320 - protein, 349 aa, Chaetomium globosum
MSKASALLATLTGAALVAAHGHVSHIIVNGVYYENYDPTTHWYQPNPPTVIGWKAAQQDNGFVEPNNFGTSDIICHKSGSPGGGHATVAAGDKISIVWDPEWPESHIGPVIDYLAACNGDCETVDKASLRFFKIDGAGYDKTAGRWAADTLRANGNSWLVQIPADLKAGNYVLRHEIIALHGASSPNGAQAYPQCINLRVTGSGTNAPSGVAGTSLYRASDAGILFNPYVASPNYPVPGPALIAGAASSVAQSKSVATATASATLPGNNNGGGPNPQPTTATTTANPGVSTTLRTSTSTSTSAQVTPPPTGGNAQTKYGQCGGSGWTGPTACAAGSSCSVLNDWYAQCV

SEQ ID NO: 321 - protein, 373 aa, Aspergillus fumigatus
MSVPKIAAALLSSAALVAGHGFVTGAVVDGKYYTGYLVNQYPYMSSPPDSIGWSETATDLGFVDGSGYSSGDIICHKDAKNGAISAEIKAGGKVEFQWTEWPESHHGPVITYMANCNGDCASVDKTTLEFFKIDESGLISDSNVPGTWASDNLIANNNSWTVTVPSSIAAGNYVMRHEIIALHSAGNQNGAQNYPQCINLKVTGGGSDKPAGTLGTALYKNTDAGILVNIYQSLSSYEIPGPALYSGASSGSSNNGGSASSSATAPSATITQPSTAVPTSSATAYQPSTTTEAVTVTSIPAQQSYVQAPTATPSSTAGSSGSGSGSSSSGTLPSSSNLTEYFNSLSAEEFLKVLKQTFSWLVTEKVHARDLSA

SEQ ID NO: 322 - protein, 319 aa, Humicola insolens
MRPFSLVALATAVSGHAIFQRVSVNGVDQGQLKGVRAPSSNYPIENVNHPDFACNTNIRHRDGTVIKIPAGATVGAWWQHEIGGPSFPGDPDNPIAASHKGPIQVYLAKVDNAATASPNGLRWFKIAEKGLSGGVWAVDEMIRNNGWHYFTMPQCIAPGHYLMRVELLALHSASFPGGAQFYMECAQIEVTGSGNFSPSETVSFPGAYPANHPGIVVSIYDAQGNANNGGREYQIPGPRPITCSGGGSNNGGGNNNGGGNNNGGGGNNNGGGNNNGGGNTGGGSAPLWGQCGGNGYSGPTTCAEGTCKKQNDWYSQCTP

SEQ ID NO: 323 - protein, 382 aa, Neosartorya fischeri
MSQTKSLSLLAVLLSATRVAAHGHVTNVVVNGVSYAGFDINSYPYMSDPPKVAAWTTPNTGNGFIAPSAYNSPDIICHQNATNAQAYIEIAAGDRIQLQWTAWPESHHGPVIDMLASCGESCTTVDKTSLKFFKIDGVGLVDNSAVPGTWGDDQLIANSNSWMVEIPKSIAPGNYVLRHELIALHGAFEEGGAQNYPQCFNLKVTGSGTDSPAGTLGTELYTESDPGLLVDIYKSIASYAVPGPAMYSGAVSITQTTSAITSTGTATVGSGADSTPVPSSAASSKYSTIAVQVPTTKAQYTPVPSSSPSTFVTSPAPSTPVPSSSSVPVTSSTAAPQPTPAPGGTQTAYGQCGGRNWTGPTACASGSTCKTWNPYYSQCVPN

SEQ ID NO: 324 - protein, 326 aa, Thielavia terrestris
MKSFTIAALAALWAQEAAAHATFQDLWIDGVDYGSQCVRLPASNSPVTNVASDDIRCNVGTSRPTVKCPVKAGSTVTIEMHQQPGDRSCANEAIGGDHYGPVMVYMSKVDDAVTADGSSGWFKVFQDSWAKNPSGSTGDDDYWGTKDLNSCCGKMNVKIPEDIEPGDYLLRAEVIALHVAASSGGAQFYMSCYQLTVTGSGSATPSTVNFPGAYSASDPGILINIHAPMSTYVVPGPTVYAGGSTKSAGSSCSGCEATCTVGSGPSATLTQPTSTATATSAPGGGGSGCTAAKYQQCGGTGYTGCTTCASGSTCSAVSPPYYSQCL

SEQ ID NO: 325 - protein, 225 aa, Chrysosporium lucknowense
MHLSATTGFLALPALALAQLSGSGQTTRYWDCCKPSCAWPGKGPSSPVQACDKNDNPLNDGGSTRSGCDAGGSAYMCSSQSPWAVSDELSYGWAAVKLAGSSESQWCCACYELTFTSGPVAGKKMIVQATNTGGDLGDNHFDLAIPGGGVGIFNACTDQYGAPPNGWGDRYGGIHSKEECESFPEALKPGCNWRFDWFQNADNPSVTFQEVACPSELTSKSGCSR

SEQ ID NO: 326 - protein, 308 aa, Chaetomium globosum
MRSTPILRTALAAALPLVAYAADGKSTRYWDCCKPSCSWPGKALVNQPVYACSANFQRITDSNAKSGCDGGSAFSCADQTPWALNDDFAYGFAATSLAGGSEASWCCSCYELTFTSGPVAGKKMVVQSTSTGGDLGSNHFDLNIPGGGVGIFDGCSPQFGGLGGQRYGGVSSRSECDAFPEALKPGCYWRFDWFKNADNPNFTFRQVQSLPKPSSSSSPVAVPKPTSTPGSVPKPTSTPGSAPEPATPTSAVPSVKTSASASPSKSSSPVSCVTEKYGQCGGNGFTGCKTCTCGTTCKKQNDWYSQCL

SEQ ID NO: 327 - protein, 315 aa, Acremonium thermophilum
MRSSPFLRAALAAALPLSAHALDGKSTRYWDCCKPSCGWAGKASVNQPVFSCSADWQRISDFNAKSGCDGGSAYSCADQTPWAVNDNFSYGFAATAIAGGSESSWCCACYALTFNSGPVAGKTMVVQSTSTGGDLGSNQFDLAIPGGGVGIFNGCASQFGGLPGAQYGGISDRSQCSSFPAPLQPGCQWRFDWFQNADNPTFTFQRVQCPSELTSRTGCKRDDDASYPVFNPPSVPGLDGSNPGNPTTTVVPPASTSTSRPTSSTSSPVSTPTGQPGGCTTQKWGQCGGIGYTGCTNCVAGTTCTQLNPWYSQCL

SEQ ID NO: 328 - protein, 305 aa, Humicola insolens
MRSSPLLPSAVVAALPVLALAADGRSTRYWDCCKPSCGWAKKAPVNQPVFSCNANFQRITDFDAKSGCEPGGVAYSCADQTPWAVNDDFALGFAATSIAGSNEAGWCCACYELTFTSGPVAGKKMVVQSTSTGGDLGSNHFDLNIPGGGVGIFDGCTPQFGGLPGQRYGGISSRNECDRFPDALKPGCYWRFDWFKNADNPSFSFRQVQCPAELVARTGCRRNDDGNFPAVQIPSSSTSSPVNQPTSTSTTSTSTTSSPPVQPTTPSGCTAERWAQCGGNGWSGCTTCVAGSTCTKINDWYHQCL

SEQ ID NO: 329 - protein, 299 aa, Thielavia terrestris
MRSTPVLRTTLAAALPLVASAASGSGQSTRYWDCCKPSCAWPGKAAVSQPVYACDANFQRLSDFNVQSGCNGGSAYSCADQTPWAVNDNLAYGFAATSIAGGSESSWCCACYALTFTSGPVAGKTMVVQSTSTGGDLGSNQFDIAMPGGGVGIFNGCSSQFGGLPGAQYGGISSRDQCDSFPAPLKPGCQWRFDWFQNADNPTFTFQQVQCPAEIVARSGCKRNDDSSFPVFTPPSGGNGGTGTPTSTAPGSGQTSPGGGSGCTSQKWAQCGGIGFSGCTTCVSGTTCQKLNDYYSQCL

SEQ ID NO: 330 - protein, 395 aa, Chrysosporium lucknowense
MKFVQSATLAFAATALAAPSRTTPQKPRQASAGCASAVTLDASTNVFQQYTLHPNNFYRAEVEAAAEAISDSALAEKARKVADVGTFLWLDTIENIGRLEPALEDVPCENIVGLVIYDLPGRDCAAKASNGELKVGELDRYKTEYIDKIAEILKAHSNTAFALVIEPDSLPNLVTNSDLQTCQQSASGYREGVAYALKQLNLPNVVMYIDAGHGGWLGWDANLKPGAQELASVYKSAGSPSQVRGISTNVAGWNAWDQEPGEFSDASDAQYNKCQNEKIYINTFGAELKSAGMPNHAIIDTGRNGVTGLRDEWGDWCNVNGAGFGVRPTANTGDELADAFVWVKPGGESDGTSDSSAARYDSFCGKPDAFKPSPEAGTWNQAYFEMLLKNANPSF

SEQ ID NO: 331 - protein, 383 aa, Magnaporthe grisea
MLFSSVLLGLTATAGVSAMPRNRGSSPRHIRRQEGANPFEGKKLFANPEWAEKAEPALAHYESIGDSANAARVRKVQQTGTFVWVSNIASLPNIDAAIEGARAAKEATGEDQIVGLVHYNLPDRDCSAGESAGELDSTKDGLRLYKETYVAPFAEKLAAATDLTFAVVLEPDSLANLVTNMGVEFCARAAPVYEEGIAHAIKSLQFDHVHLYLDAAHGGWLGWDDNLAPTAKEFAKVVAMAGGNSTVRGVVTNVSNYNPFIMPEPLEPYTEWSNSYDESHYALSLAPHLEAEGLPSRFLIDQGRVHLPGAREEWGEWCNVEPAGFGIAPGTPTENPHVDSIVWVKPGGESDGECGMEGATRAGAWFEEYFRMLVENAHPSLDS

SEQ ID NO: 332 - protein, 421 aa, Chaetomium globosum
MRSFTLLAGLLATASALPAIEPRQSGNPFSGRTLLVNPSYSESLEQTRQALANAGDQTSAGKVKFVQDKVGTFVWISNIALLADIDKAITNARAAKAKGENPVIGLVLYNIPDRDCSAGESSGELSFAQNGLARYKSEYVTPFAQKLKAASDLQFAVVLEPDAMGNMVTGTTAFCQNARGPQQDGIAYAIQQLQASNVALYLDVANGGWLGWPDNLELTADVVATILQKAGGNNRIRGYASNVSNYNPYKSANPPAYTEGSPSPDESRYADNLAAAFGQRGLPTKFIIDQGRVALDGARKEWGEWCNVYPSGFGQPFTTNTGNNNVDAIVWIKPGGESDGQCGMPGAPRAGAWFDAFAQQLAKNAHPDITAGGGNNGGGGNPGGGNCAARWAQCGGQGFTGPTCCSEGTCTVSNQWYSQCL

SEQ ID NO: 333 - protein, 365 aa, Humicola insolens
MAKKLFITAALAAAVLAQSGNPFSGRTLLVNSDYSSKLDQTRQAFLSRGDQTNAAKVKYVQEKVGTFYWISNIFLLRDIDVAIQNARAAKARGENPIVGLVLYNLPDRDCSAGESSGELKLSQNGLNRYKNEYVNPFAQKLKAASDVQFAVILEPDAIGNMVTGTSAFCRNARGPQQEAIGYAISQLQASHIHLYLDVANGGWLGWADKLEPTAQEVATILQKAGNNAKIRGFSSNVSNYNPYSTSNPPPYTSGSPSPDESRYATNIANAMRQRGLPTQFIIDQSRVALSGARSEWGQWCNVNPAGFGQPFTTNTNNPNVDAIVWVKPGGESDGQCGMGGAPAAGMWFDAYAQMLTQNAHDEIAR

SEQ ID NO: 334 - protein, 383 aa, Neurospera crassa
MRALSLLAALSAAGATVTASPVGPAHAPRALSDSNPFVGKKLFANPKWASKLEDTYKAFTSRGDSENAAVVRKVQKIGSFVWVSSRSGLSEIDEAIQAARAEQSRTGQKQIVGLVMYNIPDRDCSAGESAGELSTKNDGLRIYKEQFVKPYAAKLAAAKDLQFAVVVEPDSLGNSVTNSAVEFCKQAIPTYREGIAFAIKSLQLDNVAVYLDAANGGWLGWGDSLPKAADEIATILSMASPAKVRGFSTNVSNYNPYLATKRDSFTSGSPSYDESHYASSLAPYLQQHGLPAHFIIDQGRVAYPGARKDWGDWCNVNPAGFGHIPTTDQSVLQNSNVDAIVWIKPGGESDGQCGLKGAPIAGAWFGGYAEMLTGNADASVKNS

SEQ ID NO: 335 - protein, 375 aa, Streptomyces avermitilis
MRPSPPHARSARGLFGALLTALVSLAALLTTASVAQADTSICEPFGSTTIQGRYVVQNNRWGTSEAQCITATDSGFRITQADGSVPTNGAPKSYPSVYNGCHYTNCSPGTSLPAQLSTVSSAPTSISYSYVSNAMYDAAYDIWLDPTPRTDGVNRTEIMVWFNKVGSVQPVGSQVGTATVAGRQWQVWSGNNGSNDVLSFVAPSAITSWSFDVMDFVRQAVSRGLAQNSWYLTSVQAGFEPWQNGAGLAVTSFSSTVNTGGGNPGDPGSPTACKVAYATNVWQGGFTADVTVTNTGSSPVNGWKLAFTLPAGQQITSSWSAGVSPSSGAVTASSLAYNAQIATGGRVSFGFQGSYSGTFAAPAGFSLNGAACTTA

SEQ ID NO: 336 - protein, 492 aa, Streptomyces avermitilis
MRHPPRSALLLVAGAVALIGSAVVPVVTASGATTPACTVEYAVTSQWDAGFQGGVKITNNMAALSSWRLTFDFAGGQKVTQGWNAKWSQSGTTVTAANESYNGSLGSGASVSAGFLASWSGSNAVPTSFKLNGTTCNVEAEPSPSPSPSDPPATGAAPKLHVSGNKLVDADGKTRRLLGVNRSGGEFMCVQGYGIFDGPVDDAAVKAIADWKANTVRIPLNEECWLGLSNIKPEYGGANYIAAVKDLVARVEAHGMTPVVELHWTYGQYTGNSAGCSDVHATCQKPMPDAQYTPSFWASVASTFKDDAAVAFDLFNEPYPDRATSTTTQAWQCWRDGGTCPGITYEVAGMQDLVDAVRGTGAKNLILAGGLAYSNDLSQWLTYKPTDATGNLVAAYHVYNFNTCASETCWNSTLAPVAAQVPLVAGEIGENTCSHSFIDTVMKWFDDRGLSYLGWTWNTWDCSSGPSLISNYDGTPTSFGIGLRDHLRALNG

SEQ ID NO: 337 - protein, 882 aa, Streptomyces avermitilis
MRRTRIFTAVLALAAGLPAGTPPALAASAPTATIAADTYSWKNARVDGGGFVPGIVFNRSEKNLAYARTDIGGAYRWAESSKTWTPLLDSVGWSDWGHTGVVSLASDSVDPNKVYAAVGTYTNSWDPGNGAVLRSGDRGASWQKTDLPFKLGGNMPGRGMGERLAVDPNRNSVLYLGAPSGKGLWRSTDSGASWSQVTDFPNVGTYVQDATDTSGYASDNQGIVWVTFDESTGSPGSSTRTVYVGVADKDNSVYRSTDAGATWSRLAGQPTGHLAHKGVLDAANGCLYLAYSDKGGPYDGGKGQLWRYTTKTGTWTNISPVAEADTYYGFSGLTVDRQHPGTVMATAYSSWWPDTQLFRSTDSGGTWTKAWDYTSYPSRSNRFTMDVSSSPWLTWGANPAPPEQTPKLGWMTESLEIDPFDSARMMYGTGATVYGTDNLTNWDSGSQFTIKPMARGLEETAVNDLASPPSGGAQLFSALGDIGGFRHTDLTTVPSLMYTSPNFTTSTSLDYAETDPGTVVRVGNLDSGPHVAFSTDNGANWFAGADPSGVSGGGTVAAASDGSRFVWSPAGTGVQYTTGFGTSWSASAGLPAGAIVESDRVDPKTFYGFKSGRFYVSSDGGATFTASAATGLPSGDSVRFKALPGTKGDIWLAGGASDGAYGLWHSTDGGAAFTKLATVDQADTIGFGKAATGASYQTLYTSAKIGGVRGIFRSTDKGASWTRVNDDAHQWGWTGAAITGDPRVYGRVYVSTNGRGIVYGDTAGSSDGGGTEPAPTGACTVTYRITNQWSGGFQADVQLANTGSTAWDGWSLGWSFGDGQEVTQLWNASYAQAGSGVTAANLAWNGRVAAGSSVSFGFTGSWSGSNGRPTAFKLGGQNCTVA

SEQ ID NO: 338 - protein, 269 aa, Streptomyces avermitilis
MQHRRPRLSKKARALVATTVVLAAAAGVTVAQAGETGKKCAAFDTITLGKYYVNNNLWGQDKATGTQCVWDDSRSGSTISWGTDYSWANNSAGHDYDVKSYASSVLGWHWGWKADKAATGLPVRVGDRKSVRTTWDFSVGAGPGTMNVAYDLWLHAKNNADWQDQPTDEIMVWLNRQGGAGPLGTKYGSVSLGGAMWDIYQGDIGWKVYSFVRRTNTTKATLDLDDFTQALVRRKLLSDDKYVSGIEAGTEVFKGAGRLDTKAYSVDIG

SEQ ID NO: 339 - protein, 338 aa, Streptomyces avermitilis
MYGKRGAGALAAVALAGAALLLAGCSAPEDNSKKGGGGADIAQRPKGSDPFWVNPEGNAAEQLATYARAGRKDDAEQIRKIAEQPTGEWIGPENPEAEARGYTEAAEKADRTALLVLYNIPHRDCGQFSQGGAADGDAYRAWIDGVTKGIGDRNTTVVLEPDALLHIVDGCTPDEFHEERYDLLKGAIAKLGALKNTKVYLDAGNAGWGHPDQIFQPLQRAGVDRADGFAVNVSNFYTTRDSIAYGKQLSAKVGDKHFVIDTSRNGNGPYTAGKADENWCNPPGRALGETPSTKTADPLVDAYVWVKRPGESDGTCKGGPKAGEWWSDYALKLARASK

SEQ ID NO: 340 - protein, 370 aa, Streptomyces avermitilis
MVAVASFVVAVGTATGMMSAFDDGRTPDQARPQVTGPPSRRPLPAVPSPSPATTSARPSPATPSAGPGPKSSPSKREPTTAAAPAQLYRHPESQVLDWVGAHPDDARRAVIESRIADRPAAVWFADFAPSTITARVRAVTAAAAAQDRVPVVVPYTIPDRDCGGASQGGAPDLAAYDAWIDKFAAGLGSGEVIVILEPDSVAQSDCLSEGRQADRFASLARAGRVLKAANPGVRVYFDGGHSEWNPAAKQASLLDQAGAASPAASDGIFTNVSNFHRTSDEIAYARQVLAGLGGPASLGAVIDTSRNGNGAPAGGEWCDPAGRKIGRAPTLTTGEAGIDAYLWVKLPGESDGCKGTPGTFSPAYAYELAR

SEQ ID NO: 341 - protein, 499 aa, Bacillus subtilis
MKRSISIFITCLLITLLTMGGMIASPASAAGTKTPVAKNGQLSIKGTQLVNRDGKAVQLKGISSHGLQWYGEYVNKDSLKWLRDDWGITVFRAAMYTADGGYIDNPSVKNKVKEAVEAAKELGIYVIIDWHILNDGNPNQNKEKAKEFFKEMSSLYGNTPNVIYEIANEPNGDVNWKRDIKPYAEEVISVIRKNDPDNIIIVGTGTWSQDVNDAADDQLKDANVMYALHFYAGTHGQFLRDKANYALSKGAPIFVTEWGTSDASGNGGVFLDQSREWLKYLDSKTISWVNWNLSDKQESSSALKPGASKTGGWRLSDLSASGTFVRENILGTKDSTKDIPETPSKDKPTQENGISVQYRAGDGSMNSNQIRPQLQIKNNGNTTVDLKDVTARYWYKAKNKGQNFDCDYAQIGCGNVTHKFVTLHKPKQGADTYLELGFKNGTLAPGASTGNIQLRLHNDDWSNYAQSGDYSFFKSNTFKTTKKITLYDQGKLIWGTEPN

SEQ ID NO: 342 - protein, 381 aa, Clostridium phytofermentans; identical to SEQ ID NO: 55

SEQ ID NO: 343 - protein, 441 aa, Thermobifida fusca
MSPRPLRALLGAAAAALVSAAALAFPSQAAANDSPFYVNPNMSSAEWVRNNPNDPRTPVIRDRIASVPQGTWFAHHNPGQITGQVDALMSAAQAAGKIPILVVYNAPGRDCGNHSSGGAPSHSAYRSWIDEFAAGLKNRPAYIIVEPDLISLMSSCMQHVQQEVLETMAYAGKALKAGSSQARIYFDAGHSAWHSPAQMASWLQQADISNSAHGIATNTSNYRWTADEVAYAKAVLSAIGNPSLRAVIDTSRNGNGPAGNEWCDPSGRAIGTPSTTNTGDPMIDAFLWIKLPGEADGCIAGAGQFVPQAAYEMAIAAGGTNPNPNPNPTPTPTPTPTPPPGSSGACTATYTIANEWNDGFQATVTVTANQNITGWTVTWTFTDGQTITNAWNADVSTSGSSVTARNVGHNGTLSQGASTEFGFVGSKGNSNSVPTLTCAAS

SEQ ID NO: 344 - protein, 616 aa, Thermobifida fusca
MTPLTRRLRAGAAAIAIGASALIPLTSSPAAASGTADWLHTDGNRIVDSAGNEVWLTGANWFGFNTSERMFHGLWAANIEDITSAMAERGINMVRVPISTQLLLEWKNGQAGPSGVNEYVNPELAGMNTLEVFDYWLQLCEEYGLKVMLDVHSAEADNSGHYYPVWYKGDITTEDFYTAWEWVTERYKNNDTIVAADIKNEPHGKANETPRAKWDGSTDIDNFKHVCETAGKRILAINPNMLILCEGIEIYPKDGQDWSSTDGRDYYSTWWGGNLRGVADHPVDLGAHQDQLVYSPHDYGPSVFEQPWFEGEWNRQTLTEDVWRPNWLYIHEDDIAPLLIGEWGGFLDGGDNEKWMTALRSLIIDEKMHHTFWALNPNSGDTGGLLNYDWTTWDEAKYAFLKPALWQDANGKFVGLDHDVPLGGVGSTTGVSLNQYYGGGGPSQPPTEPTEPPTEPTEPPTEPTEPPANPTGALEVYYRNNSLAADDSQIAPGLRLVNTGSSTVDLADVEIHYYFTNEPGGTLQFTCDWAQVGCANVNASFTSLSAPGADTSLVLTLSGSLAPGASTELQGRIHTANWANFDESDDYSRGTNTDWELSEVITAYLGGTLVWGTPPA

SEQ ID NO: 345 - protein, 1711 aa, Anaerocellum thermophilum
GSFNYGEALQKAIMFYEFQMSGKLPNWVRNNWRGDSALKDGQDNGLDLTGGWFDAGDHVKFNLPMSYTGTMLSWAVYEYKDAFVKSGQLEHILNQIEWVNDYFVKCHPSKYVYYYQVGDGSKDHAWWGPAEVMQMERPSFKVTQSSPGSTVVTETAASLAAASIVLKDRNPTKAATYLQHAKELYEFAEVTKSDAGYTAANGYYNSWSGFYDELSWAAVWLYLATNDSTYLTKAESYVQNWPKISGSNTIDYKWAHCWDDVHNGAALLLAKITGKDIYKQIIESHLDYWITGYNGERIKYTPKGLAWLDQWGSLRYATTTAFLAFVYSDWVGCPSTKKEIYRKFGESQIDYALGSAGRSFVVGFGTNPPKRPHHRTAHSSWADSQSIPSYHRHTLYGALVGGPGSDDSYTDDISNYVNNEVACDYNAGFVGALAKMYQLYGGNPIPDFKAIETPTNDEFFVEAGINASGTNFIEIKAIVNNQSGWPAKATDKLKFRYFVDLSELIKAGYSPNQLTLSTNYNQGAKVSGPYVWDASKNIYYILVDFTGTLIYPGGQDKYKKEVQFRIAAPQNVQWDNSNDYSFQDIKGVSSGSVVKTKYIPLYDGDVKVWGDGPGTSGATPTPTATATPTPTPTVTPTPTPTPTSTATPTPTPTPTVTPTPTPTPTATPTSTPTPTSTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPVAGGQIKVLYANKETNSTTNTIRPWLKVVNTGSSSIDLSRVTIRYWYTVDGDKAQSAISDWAQIGASNVTFKFVKLSSSVSGADYYLEIGFKSGAGQLQAGKDTGEIQIRFNKSDWSNYNQGNDWSWMQSMTNYGENVKVTAYIDGVLVWGQEPSGATPTPTATPAPTVTPTPTPTPTSTPTATPTATPTPTPTPSSTPSVVGEYGQRFMWLWNKIHDPANGYFNQDGIPYHSVETLICERPDYGHLTTSEAFSYYVWLEAVYGKLTGDWSKFKTAWDTLEKYMIPSAEDQPMRSYDPNKPATYAGEWETPDKYPSPLEFNVPVGKDPLHNELVSTYGSTLMYGMHWLMDVDNWYGYGKRGDGVSRASFINTFQRGPEESVWETVPHPSWEEFKWGGPNGFLDLFIKDQNYSKQWRYTDAPDADARAIQATYWAKVWAKEQGKFNEISSYVAKAARMGDYLRYAMFDKYFKPLGCQDKNAAGGTGYDSAHYLLSWYYAWGGALDGAWSWKIGSSHVHFGYQNPMAAWALANDSDMKPKSPNGASDWAKSLKRQIEFYRWLQSAEGAIAGGATNSWNGRYEKYPAGTATFYGMAYEPNPVYHDPGSNTWFGFQAWSMQRVVEYYYVTGDKDAGALLEKWVSWVKSVVKLNSDGTFAIPSTLDWKRQPDTWNGAYTGNSNLHVKVVDYGTDLGITASLANALLYYSAGTKKYGVFDEGAKNLAKELLDRMWKLYRDEKGLSAPEKRADYKRFFEQEVYIPAGWIGKMPNGDVIKSGVKFIDIRSKYKQDPDWPKLEAAYKSGQAPEFRYHRFWAQCDIAIANATYEILFGNQ

SEQ ID NO: 346 - protein, 474 aa, Chaetomium globosum
MLSPALASSLLVVLGAAGAHAQQRQALWGQCGGSGWNGPTACVDGAYCFQQNQWYHQCIPGSDRSPSPTNPPQQSSTLTTSRVTVAPPTSTSPAPGGGGTTCPATPSGQGSPVANALNDPFTFHGGGKVSSKADWTCRQAEISKLLQQYELGTLPPKPSSVTASFSGSTLSISVSEGGKSISFSVSINNRPSSSGPHPAIINFGTFGGLPVPAGVATINFNNDEIAQQQDQSSRGKGKFYDIYGSGHSAGALTAWAWGVSRIIDALELTRAQTNIDPARIGVTGCSRNGKGAMVAGALEPRIALTLPEESGAGGSGCWRIATWQKNRGENVQESKQIVTENVWFSTNFNSQVNNVNALPFDHHMLAGLIAPRALYVMENTDMEWLGKVSTYGCMGIARKQWEALGALDSFGYSQVGGNSHCSFPSSQQGSELNAFIGKYLLNNPNAGNTNIFRSTGNQNFDLNSWSPWTVPKLS

SEQ ID NO: 347 - DNA, 9028 bp, Artificial Sequence
  pMU1934
gagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatactaaacaagaccaacataataatggtggaaccatttactgtattttcaatgtaacatttaaatccgcggtaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtgtttaaacacctcatctataatttttaccctgatctaactaactttggcatgcctggttcaatctacgggttacagtcatcgttgaaaacgatggaaaaacatgtcgagattcctcaatccatacaccattatagtccgttttatcagcttccactaattttttaaatctcagtttcttcttgaaatttagcatcgtgcatgggatagcggctagtaaaaaagaaaattaatatctcattaacaaagttattgtacataatccggtacaatattcttcaatgtactctctaatatcgagcacactggcaatattcatgcacacattcgcctaatgctgacgaatgcttaatcagtgcaattactgccaccctcttgatatgtgggctaaatcctttaggacctgtaaaaaatgcaatcacgttttcacatttttttttttcttgcggaattgcggaatttcccagttggcagcgttatccgatttgagatcgacttgcatcaacctttgaaaaatataaggatgagaaagtgaaatcggttttttttttccattgtcgtcatcaacatgattttttaaataaataaatacgattttttattttttttcccttctttgtttttgttttgcttattcccatcttcattattaaattcttccgctcttaataaaggagtttttttattatcttcttgtgtaatcatcctttttctttaattttcttccttttctttttctctttactggtttttttacttctttattctcaaccatctaaagaatattattgctttctaccaataaaatctgttaattctatttggattgtcgtctactcaagtctcgcctagtaaataaacgataaacaaatttgaagtaagaataacaatatagggagagaaatttttctatttttaatttcgaaacaggtaccaaaaaatctaagttcactttagcactatttgggaaagcttttatataaaaaatctgaaacaaaatcatatcaaagttaataattaaaatgagagctttgtctgttttttttgctttgttctgtttcttggctttatcttctgcttctccaggtcaagatgttgttaaaagagttacttctggttctttgcaacaagttactaattttggttctaatccatctggtactttgatgtacatttacgttccaaagaatttggctactaaaccaggtattgttgttgctattcattattgtactggtactgctcaagcttattatactggttctccatatgctcaattggctgaacaatacggttttattgttatctatccacaatctccatattctggtacttgttgggatgtttcttctcaatctgctttaactcataatggtggtggtgattctaattctattgctaacatggttacttggactatttctcaatacaatgctgatacttctaaggtttttgttactggttcttcttctggtgctatgatgactaatgttatggctgctacttatccagaattgtttgctgctgctactgtttattctggtgtttctgctggttgtttttactcttcatctaaccaagttgatgcttggaactcttcttgtgctcaaggtaatgttatttctactccagaagtttggggaggtattgctaaagcaatgtatccaggttatactggtccaagaccaagaatgcaaatttatcatggttctactgatactactttgtacccacaaaattactacgaaacttgtaaacaatgggctggtgtttttggttacaattacaactctccacaatctactcaatctaatactccacaagctaattaccaaactactatttggggtccaaatttgcaaggtatttttgctactggtgttggtcatactgttccaattcatggtgaacaagatatggaatggtttggttttgcaggtggttcttctactactactacacaaccaactactacttctactacaacatcttctggtggttcttcaactggtactggtgttgctgctcattggggtcaatgtggtggtaatggttggactggtccaactgtttgtgcttctggttatacttgtactgttgttaatgcttggtattctcaatgcttataaggcgcgcgcgccc

SEQ ID NO: 348 - DNA, 11046 bp, Artificial Sequence
  pMU2143
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcgcggccgctgttggaacgagagtaattaatagtgacatgagttgctatggtaacaattcaatgcttacatcgtatattaatgtacaactcgtatacgtttaagtgtgattgcgcctattgcagaaggaatgttaaacgagaagctcagacaatactgaagctgtgttaaagacctattagttgaacatgttatgttcgaagaaggatgttattatatgatctctgatggcgaaatggcagtactcgggggaatgctctcatgtgtaccttttgattggaattggttcgcagtgtttatgttatattagctcaatgtgctccctgtattttatatatgaaacaagtctttgtattgctatttttttcaaacctttttctcaactctaaaagcggtccacgttagttttctttggatatagcagttgttgtacactagcttaagatgtaaaattcaattcaatatgattttgtgtgggatgttttaaagaaggcacaagcctgttctctctttttctcttttttcatggattgtatcgcttaaaagggagaaatgaagtaaacgattctttttgtaaaaatataaaaccaaattttttaatttatatgtatacatatttatttatgacgtaagaccaagtaagtttatatgaaagtattttgtgtatatgacggaaagaaatgcaggttggtacattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttgccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgaaacgtgagtcttttccttacccatggttgtttatgttcggatgtgatgtgagaactgtatcctagcaagattttaaaaggaagtatatgaaagaagaacctcagtggcaaatcctaaccttttatatttctctacaggggcgcggcgtggggacaattcaacgcgtctgtgaggggagcgtttccctgctcgcaggtctgcagcgaggagccgtaatttttgcttcgcgccgtgcggccatcaaaatgtatggatgcaaatgattatacatggggatgtatgggctaaatgtacgggcgacagtcacatcatgcccctgagctgcgcacgtcaagactgtcaaggagggtattctgggcctccatgtcgctggccgggtgacccggcggggacgaggcaagctaaacagatctctagacctaggctcttcattgagcttagaacccttttgggcagaaagatatccgtcgaacaacgttctattaggaatggcggataaattatttaaattatatcacactaattttcctcctgtggtagccctaagaacttttggtttgaatctgacgaataagatcggtccagttaagaatatgatcattgacacattaggaggaaatgagaaatgagaggtatgtaaatagaaatagactagctccacttttaagaattatttatgcaattaaatacatgggtgaccaaaagagcgggcggatacacgcgtcaccacaagcagaataaaaggtaaacctgaaattgttttaacataaaatgaaaaatgcttgtttgcaaccctatatagaatcataaaacattcgtgactataaaatgaataaactaaactattctaagaaaatgaaataaatgacaaaaaaacgtgttttttggactagaaggcttaatcaaaagctctcgagggcgcggcgcgccttagaatggtggatttgcgttcgttaacaattgttcaaaataagcctggaaccattgtccagcctcgggggcgggctgtaaagcgtcggacagaccacagtggtaatcgtatcttgcagcactcgtgtcacttgttccgtcactttcgccacctggcttaacccatacaaaagcgtcgactagctcgtgtccggtgtttgccgtaggcctgacgccgaagccggttcccttgacgttacaccaatctccccattgttgttgtccagttggttgtttgccgtttctaccggtatccacgatgaatctggcagggaatccagcggagtttaacaatggggaaaatgcttctatgtaatgtttctcatcgtagttaggatttggtgaggtataagaaggggcactagcaattgaccaagcgttgtaatttgcaacatttgtggctaagcctctaacggcagcgggctttccggcgtcgttgtagattccagcgaacaattcagctgcgggttggatatttgcaggccagcccaaccatccggcatgaccggcatctaagtacatagcaacgttaggtagattcagttgttttaatgcatatacggttagctcatggtatgtggaagctgcgttagaacacttggctacattcatgttggtaaccatattagccatggagtctggttcaatcacaaggattattctaatatcagaatactcaatgatgtgttttcttattgcatcaatgtatgatctatagtttgcagctccgccatttgcgatggaaaattcaccattagaagctgcggcagcacagtctctatctggcaagtcatagactactaattgggcagcataaggtgggttggcaccggccttattcaaagctctaacctgagataaagtctgtaccataagtgtatctattgtaacgtttctgtcaagccattggaaactagggacttctgctacggcggaagcctttgcggctagggttcccgtcatagaaggaattgcaaggttgtgaacctctgatctataatagtcgtttgcaaataatctcactccagagaaaggattgccggaataactggctgttgaggttgctccgccagggatactcgtgacaggacttgatacgggtggaggggtcgtactgctagatgaggatgagccacttctggttgtgctagaagaggtacttgtggatctctgtgaagtagacgttgagctgggggttgttgaagaagtcacctgggagtttggaaggcactgggaataccactcgttctgtgccacgcacgttgagccagaagcacaacatgttgggccttgccagccgttgcctccgcactgtgtccagacggctccgcaattttgtctctcttcgatcactggtgcagcaagcactgcggcagctaaggcagcggtaatgaacaacttcttggccattgtttaattaagttttatatttgttgtaaaaagtagataattacttccttgatgatctgtaaaaaagagaaaaagaaagcatctaagaacttgaaaaactacgaattagaaaagaccaaatatgtatttcttgcattgaccaatttatgcaagtttatatatatgtaaatgtaagtttcacgaggttctactaaactaaaccacccccttggttagaagaaaagagtgtgtgagaacaggctgttgttgtcacacgattcggacaattctgtttgaaagagagagagtaacagtacgatcgaacgaactttgctctggagatcacagtgggcatcatagcatgtggtactaaaccctttcccgccattccagaaccttcgattgcttgttacaaaacctgtgagccgtcgctaggaccttgttgtgtgacgaaattggaagctgcaatcaataggaagacaggaagtcgagcgtgtctgggttttttcagttttgttctttttgcaaacaaatcacgagcgacggtaatttctttctcgataagaggccacgtgctttatgagggtaacatcaattcaagaaggagggaaacacttcctttttctggccctgataatagtatgagggtgaagccaaaataaaggattcgcgcccaaatcggcatctttaaatgcaggtatgcgatagttcctcactctttccttactcacgagtaattcttgcaaatgcctattgtgcagatgttataatatctgtgcgtcttgagttgaagtcaggaatctaaaataaaaattaaggttaataaaaagaggaaagaaaaaaaaattaatcgatttacagaaacttgcacactaaaaatacacaactaaaagcaattacagtatgggaagtcatcgacgttatctctactatagtatattatcatttctattattatcctgctcagtggtacttgcaaaacaagatgagaccccattctttgaaggtacttcttcgaaaaattcgcgtctaactgcacaagataagggcaatgatacgtgcccgccatgttttaattgtatgctacctatttttgaatgcaaacagttttctgaatgcaattcgtacactggtagatgtgagtgtatagaagggtttgcaggtgatgattgctctctgcccctctgtggcggtctatcaccggatgaaagcggtaataaggatcgtcccataagagcacaaaatgacacctgtcattgtgataacggatggggagggatcaattgtgacgtttgtcaagaagattttgtctgtgatgcgttcatgcctgatcctagtattaaggggacatgttataagaatggtatgattgtagataaagtattttcaggttgtaatgtgaccaatgagaaaattctacagattttgaacggcaaaataccacaaattacatttgcctgtgataaacctaatcaagaatgtaattttcagttttggatagatcagttagaaagcttggtaggtacatatatgaggaatatgagtcgtcacatcaatgtatagtaactaccggaatcactattatattggtcatgattaatatgaccaatcggcgtgtgttttatatacctctcttatttagtataagaagatcagtaattatttcttcattaatactaatttttaacctctaattatcaacagcggccgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 349 - DNA, 8532 bp, Artificial Sequence
  pMU2173
gcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaaatgttgttgcaagcttttttgtttttgttggctggttttgctgctaaaatttctgctcatcatcaccaccaccacccaccttctccaccttctgatgatgatgacaaatccgttgctgtttatgatccaccagttattaacactttccatcaatgtgatccagctgctcatgtttggaaacatgatccaaatactgtttacgtttacggttctcatgatgttaattctactaagaatccaccagttcaatatgatatgaaggattactacgttttgattcaagttgatattactaaaccagctactgttggtccaaagattttggatttgccagatattccatgggcttctcaacaattgtgggctccagatgttgctgaaaaaaatggtgaatacttcttgtattttccagctaaagataaggatggtgtttttagaattggtgttgctaaatctgataaaccagacggtaaattcaaagctgaaccatcttatattccaggtgcttattctattgatccagctattttggctgatgatgatggttgttactacatgtattttggtggtttgtggggtggtcaattgcaagcttggccaaacaatactttgaatacttctgctttcggtaatatttctccatcttctggtccagctttgggtccaagatttgctaaattgtctgctaatatgacacatttggctactgaaccaaaagaattggttatctacgataaagatggtcaagttatgcaagctaattctactagaagatactttgaagctccatctattaacaaagttggtaacttgtattacttgcaatattctactggtacttctcatactattgaaattgctgttggtaaaaaaccagaaggtccattttattggaaatctaccttgttgcaaccagttaaaggttggactactcatgaatctattgttaagtttaagggtgattggttgttgtattatgctgatgcttctttgactggtattgatgatttgagaaacactaaggttagaaagttgaattttgctaatggtacttttgctttggctcaaccacaaccatatactccatttccatcttcataaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcggccgcaagctaattcgcgcgaagctagcttggcactggccgtcgttttacaacgtcgtgactgggaaaaccctggcgttacccaacttaatcgccttgcagcacatccccccttcgccagctg

SEQ ID NO: 350 - DNA, 4843 bp, Artificial Sequence
  pMU2437
ggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtcaattcgcggccgcggtacccggggatcctctagagtcgacctgcaggcatgcgagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgaggcgcgccgattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactcataagtgtaccgaagactgcattgaaagtttatgttttttcactggaggcgtcattttcgcgttgagaagatgttcttatccaaatttcaactgttatatagaagagcaaaaaattgccaaaaaaaacaacatttattcatttgaaatataaaatttgggcttctatattttaatattgcttttcaattactgttattaaaggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagcccttcaaacttcccaaaggcgagccctagtgacattagaaaaccgactgtaaaaagtacagtcggcattatctcatattataaaagccagtcattaggcctatctgacaattcctgaatagagttcataaacaatcctgcatgataaccatcacaaacagaatgatgtacctgtaaagatagcggtaaatatattgaattacctttattaatgaattttcctgctgtaataatgggtagaaggtaattactattattattgatatttaagttaaacccagtaaatgaagtccatggaataatagaaagagaaaaagcattttcaggtataggtgttttgggaaacaatttccccgaaccattatatttctctacatcagaaaggtataaatcataaaactctttgaagtcattctttacaggagtccaaataccagagaatgttttagatacaccatcaaaaattgtataaagtggctctaacttatcccaataacctaactctccgtcgctattgtaaccagttctaaaagctgtatttgagtttatcacccttgtcactaagaaaataaatgcagggtaaaatttatatccttcttgttttatgtttcggtataaaacactaatatcaatttctgtggttatactaaaagtcgtttgttggttcaaataatgattaaatatctcttttctcttccaattgtctaaatcaattttattaaagttcatttgatatgcctcctaaatttttatctaaagtgaatttaggaggcttacttgtctgctttcttcattagaatcaatccttttttaaaagtcaatcccgtttgttgaactactctttaataaaataatttttccgttcccaattccacattgcaataatagaaaatccatcttcatcggctttttcgtcatcatctgtatgaatcaaatcgccttcttctgtgtcatcaaggtttaattttttatgtatttcttttaacaaaccaccataggagattaaccttttacggtgtaaaccttcctccaaatcagacaaacgtttcaaattcttttcttcatcatcggtcataaaatccgtatcctttacaggatattttgcagtttcgtcaattgccgattgtatatccgatttatatttatttttcggtcgaatcatttgaacttttacatttggatcatagtctaatttcattgcctttttccaaaattgaatccattgtttttgattcacgtagttttctgtattcttaaaataagttggttccacacataccaatacatgcatgtgctgattataagaattatctttattatttattgtcacttccgttgcacgcataaaaccaacaagatttttattaatttttttatattgcatcattcggcgaaatccttgagccatatctgacaaactcttatttaattcttcgccatcataaacatttttaactgttaatgtgagaaacaaccaacgaactgttggcttttgtttaataacttcagcaacaaccttttgtgactgaatgccatgtttcattgctctcctccagttgcacattggacaaagcctggatttacaaaaccacactcgatacaactttctttcgcctgtttcacgattttgtttatactctaatatttcagcacaatcttttactctttcagcctttttaaattcaagaatatgcagaagttcaaagtaatcaacattagcgattttcttttctctccatggtctcacttttccactttttgtcttgtccactaaaacccttgatttttcatctgaataaatgctactattaggacacataatattaaaagaaacccccatctatttagttatttgtttggtcacttataactttaacagatggggtttttctgtgcaaccaattttaagggttttcaatactttaaaacacatacataccaacacttcaacgcacctttcagcaactaaaataaaaatgacgttatttctatatgtatcaagaatagaaagaactcgtttttcgctacgctcaaaacgcaaaaaaagcactcattcgagtgctttttcttatcgctccaaatcatgcgattttttcctctttgcttttctttgctcacgaagttctcgatcacgctgcaaaacatcttgaagcgaaaaagtattcttcttttcttccgatcgctcatgctgacgcacgaaaagccctctaggcgcataggaacaactcctaaatgcatgtgaggggttttctcgtccatgtgaacagtcgcatacgcaatattttgtttcccatactgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctac

SEQ ID NO: 351 - DNA, 8628 bp, Artificial Sequence
  pMU2816
cgatttttttctaaaccgtggaatatttcggatatccttttgttgtttccgggtgtacaatatggacttcctcttttctggcaaccaaacccatacatcgggattcctataataccttcgttggtctccctaacatgtaggtggcggaggggagatatacaatagaacagataccagacaagacataatgggctaaacaagactacaccaattacactgcctcattgatggtggtacataacgaactaatactgtagccctagacttgatagccatcatcatatcgaagtttcactaccctttttccatttgccatctattgaagtaataataggcgcatgcaacttcttttctttttttttcttttctctctcccccgttgttgtctcaccatatccgcaatgacaaaaaaatgatggaagacactaaaggaaaaaattaacgacaaagacagcaccaacagatgtcgttgttccagagctgatgaggggtatctcgaagcacacgaaactttttccttccttcattcacgcacactactctctaatgagcaacggtatacggccttccttccagttacttgaatttgaaataaaaaaaagtttgctgtcttgctatcaagtataaatagacctgcaattattaatcttttgtttcctcgtcattgttctcgttccctttcttccttgtttctttttctgcacaatatttcaagctataccaagcatacaatcaactatctcatatacattaattaaacaatggttcagatcaaggtagctgcactggcgatgcttttcgctagccaggtactttctgagcccattgaaccccgtcaggcttcagtgagtattgataccaaattcaaggctcacgggaagaaatatcttggaaacattggtgatcagtacaccttgaccaagaactcgaagactccggccattatcaaggccgattttggcgcgttgactccagagaacagcatgaagtgggatgctactgaacccagccgtggacagttctctttctcaggatcggactacctggtcaactttgcccagtctaacaacaagctgatccgcggacatactctcgtgtggcactcgcagctcccctcctgggtccaatccatcacggacaagaatacactgatcgaagtcatgaagaatcacatcaccacagtgatgcaacactataagggcaagatttatgcctgggatgttgtcaatgaaatcttcaacgaagacggctccctacgcgacagcgtcttttacaaggtcatcggcgaggactacgtgcggatcgccttcgagactgctcgggctgcagatcccaatgcaaagctctacatcaatgattacaacctggattccgcctcctaccctaaattgaccggcatggttagccatgtcaagaagtggatcgcagctggcatccctatcgatggaatcggttcccaaacccacttgagcgctggtggaggtgctggaatttctggagctctcaatgctctcgcaggtgccggcaccaaggagattgctgtcaccgagcttgacatcgctggcgccagctcgaccgactacgtggaggtcgtcgaagcctgcctgaaccagcccaagtgtatcggtatcaccgtttggggagttgctgacccggattcctggcgctccagctccactcctctgctgttcgacagcaactacaacccgaagcctgcatacactgctatcgcaaatgctctctagttataaggcgcgccgcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgcggtccatgtaaaatgattgctccaatgattgaaataaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatcca

SEQ ID NO: 352 - DNA, 8819 bp, Artificial Sequence
  pMU2981
ctagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaatgacaccacacagcatcgatagagccgcaagaccttccgtatggtctggtctagccttattacttagtacggcccacgccatagtgatgcctgatggagttacaggtaaagtgccatcattgggttggaatagttggaatgcctaccactgcgatatagacgaatctaagtttttgtctgccgctgaagtaattgtttcctccggtttgttagatgctggatacaattacgtgaatatcgatgattgctggtcaatgaaggacgggagagttgatggtcatatagcggttaatacaacaagatttccagatggaattgatgggttagcgaaaaaggttcatgacttgggactgaagctaggcatctactctacagctggaactgctacttgtgctgggtatcctgcttctcttggttatgaagatgtagatgcagccgactttgcagactggggagtagactacttgaagtacgacaattgtaatgtgccttctgattggcaggatgaatatgttgcttgcgcaccagacgctgtccaaacgggtccaaacggcacctgttctactgccttggaaccaaatcttgcaccaccaggttatgattggtctacctcaaaatcagctgaacgattcaatgctatgcgtaacgcattagcaaaacagtctagggaaatcgtcttgtcactgtgtatttggggcgtcgcggatgtattttcctggggtaatgaaacaggaatatcttggagaatgtcaggtgatattagtccagaatggggctcagtgactcatatcatcaacatgaattcctttaagatgaactcagtcggattttgggggcacaacgacgctgatattttggaagttggtaatggtaacctcactgcagctgagactagaactcatttcgcattgtgggctgcaatgaaatcacctctactaattggcactgacttagctcaactgtctcaagagaacattgagctacttaaaaacaagcatctcttagccttcaaccaagattcagtttacggtcaaccagccactccttacaaatggggcgtcaatccagactggacattcaactacaccaatcctgcagaatattgggctggtccaagctctaaaggccatctcgtgcttatgatgaatacactagatcatacagtcagaaaagaggcaaaatggagtgagatccctggcctgtctgcaggtagatacgaagtaagagatgtttggaccgataaaagcttgggttgtttgtctagttacaagacagcggttgctgctcatgatacagcagttatcttagtcgggaaaaagtgtcgtaactgggatgatgatgatgacaaaggtggttctcctccttctcatcatcaccaccaccactaaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcggccgcaagctaattcgcgcgaagctagcttggcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatcca

SEQ ID NO: 353 - DNA, 8585 bp, Artificial Sequence
  pMU3131
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaagttctccttcctcaccgtggccagcttcctcatagggcaagtagccctggccgctttgtcagctaaaaagttcgccagtgcatctgatctacaattcacaatagacgggaaaaccggttactttgcaggttctaattcatactggattgggtttttaactaataacgcagatgttgatctagtgtttgatcacatgaaggagtcaggcttgaagatcctgcgtgtatggggctttaatgacgtaaacacagtaccagggcaaggaacagtgtattaccaagtccatgctaatggtaagtcaacaatcaacacaggcgctgacggtttacaaagattggattacgttgtccattccgctgagaaaagaggcatcaaattgattatcaactttgttaataactgggatgattatgggggcatgaatgcttacgtgaaggcctatggcgaaactgatcataatgcattttactctaacaaaaatatacagaatgcctacaggagatatgttaaggcagtagtttctagatacaccaatagtccagcggtctttgcctgggaactagctaatgaacctagatgtaaaggttgtgacaccgaagttttatacgaatggattaagtctacttccgaatacatcaaaaagttagataaaagacacatggtctgcattggagatgaaggatttggtcttgatctgttgagcgacggttcatacccatacacttatgttgaaggttccaactttacgagaaaccttgcaataccaacaatcgattttggtacttttcatttgtacccagactcctggggtacaacacatgaatggggcaatggctgggctcaatctcatggagcagcttgcaaagcagctggtaaaccatgcctattcgaggaatatggtgttacatctaatcattgtgctttagaaactccttggcagaaaacatcacttaatacgactggagtcagtggagacttgtactggcaatacggagacactttatctactggacaatcaccaaacgatggtaacactatctactatggcacagatgagttcaaatgtattgttaaggatcatgttgcagctattaaggcgaaacagggttgggtggatgatgatgacaaaggtggttctcctccttctcatcatcaccaccaccactaagg

SEQ ID NO: 354 - DNA, 8519 bp, Artificial Sequence
  pMU3138
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcatcggtggcaattgcttctagggcttgtttttgcaatcgaagcagcttcagctcatccaagatcatggggtcctagaaagttcacaagtctggtttccttcggtgactcctacacagatcagtcaagactaaactactttggttctcataacggatctgcgccaccaataggctgggagcaaccagactctaacaatacagcatctgggggatacgtgtggggacattatgtcagtcagtacgctgacgtgaacttatacaattatgccgtgtctggcgcagtatgctctaatgaaatcacacctagaacttttagttcaatcaatgctcctttcccatctgtactggaatatgaggttagcgcatttttggctgattcaaaacacaaagtttccggtaagagatttttacacattccaccaagggagactgtctactctatatggattggcactaatgacctcggcaactacgctttcattacagattcccaagtcaaggataaaaccatccctgattacattaactgtgtttactcagttttagacagagtttatgtgtctggtggtagatactttgtactcatgaatctggccccattgcaattagctcctttgtacgcaactccagaaaatggtggggtaggcgctaatcattactggccagacaaaccagataacttaactctaacttcatatagaatgtgggaacaagttgcgactgtgaaccatgtttttcaataccaaaccccttacgaacttttggtcgctagaagatacccaggtgctcgttttgccgtcatggacatgtatggtttgttgtctgaagtctactataatccaacaaaatacttcaatggaagcgcacaggccaatgtaacagggtttaacaatcattgtaccttagatggcggtcaatgtacaagactaccaagtcctgattcattcatgtggttcgatgaacttcatccatcccaacgaacagatcaaatcattgccgaagagtttgttaaggttgtaggaggagattcaaagtgggccacgtattgggatgatgatgacaaaggtggttctcctccttctcatcatcaccaccaccactaagg

SEQ ID NO: 355 - DNA, 10457 bp, Artificial Sequence
  pMU3220
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaagctgatttggcctacgtctcttctctttacggccctggtggcagccgaaccttacttgttattttcatctggcacctctgaataccaacttgcgtctaatactactgcaccagctgtttgggtagcgcaaaatgaaccagtaggcgtattaagagctgctcacgatctagccaacgattttggtagagttttgggtgtcaatggtactgttaatgttttcgacactgatatttctgagtcaccaggtaaagcagtaatcatcactggcacagtgggtcaatccacgccaatcgatcaacttgtttccgatgggaaactcgatgtgtccctgatagaaggaaagtgggaaagttatgtgtctcgtatcgttgaaaatccatttccaaacgtgacatggtcactcgttgtagctggttctgacagaagaggtacaatctacggcttgtacgatataagtgagcaaatgggtgtctctccttggtactggtgggcagacgtccctgttaagaccaaaacaggaatatgggtcgctccagaaggaactttccaaaagtcaccatctgtgaagtatagaggtttcttcatcaatgatgagagtcctgcattgtcaggatgggtggccgagaatttcggtaccaagtttaactctgccttctatagacatatctttgaattatgtttgagactgaagggaaactacctgtggccagctatgtgggggaaaatgttttatgtcgatgatgtcgataatggccaactcgcccatgaatacggtatcattatgggtacaagtcatcatgaaccaatggcacgatcagaacaggagcagaaaacgtacctggatggtgaatggaattggaacgaaaatcaagccaacattacaacatttttccaacaaggcattgatagagccaaacattgggatacaatatggactatgggaatgagaggtgaaggtgacgtggcttctcctacgttgactgctgccgatctggaagagttgattcacgcacaacaaaaattgttggtcgaatcattcaacgcctccgatcctgcaagtattccacaaacatgggtcctatacaaagaggtttcagactactacgccgctggcatggaagtccctgagtcagtcacactactttggacagatgataattcaggtaatctcatcagagttccaatagctaatgaaacatctagagttgcaggtgctggcgtatactaccactttgactacgttggttccccaaggtcttacaaatggataaactcaatacaattggttaagacctgggagcaaatgcatctagcataccaaaaatcagcaagacaaatctggattgcaaacgtgggggacatcaaaggtcttgaagtcccactcactcactttatggacatggcctatgacatggataggtttacgtctacagactcaacaacaaaatggttgaagcgttgggcagcgagagagtttaacgaaaggattgccgatagaacagctgatatcttaaaccactatggcacattagttgccagacgtaagtacgagctattgtcacaactgccattcgctttctctactatctactatgacgaagcagaggcgaatcttgctcaatgggagagtttacttgcccaaacacaatcagtctattcaagtttagatcaagctaccagaaccccatttttcgaaatgtttttacatcctgtcctagcgggtaaaactgtagtggatctgtatacaaaaacagcttttaatgcactctaccatcaacaaggtagaatatctacaaacagattagctcagaaggttcatgacttgtttacagaggacagtgccattacggaaagataccacggggtgaaaggagggaaatggaggcctgtcatggatcaggttcacatcggctactcaagctgggatgatccagttgataatacaaatgtaatgccagctctatcttacatcgccgctccacaaggagcgggtggaataggcattgcagttcagggttcagcagcttcctacccagagcaaaagacactaagacttttgtctatggacccttacatgccacctagtgaatccagatacattgatatctttgcaaggaaaaatacaacggtgacgtattcaattagctccaatactagctacgtgacagtatctaacgcttcaggcagtgtctctgcaagcagcaatatcagcgatgttagatccaccatcactgtagactgggcatccgcagaacctggactttcccataccgaactccaagtgagagccggagatggcttcactgctgctctagtacttccagtcaataatacttttgtcccaactaactttactggttttgtcgagtccaatggagttatctccatcgaagcgtcacattatacatccgctgaaacaaaatctaatgtatcatacgttgaaatccctcattatggtagaacattatcagcagttatgccttggccagttactatggggacacagcatcctaacactggaccagctttaagatactcattgtacactactacagcttctccaagcgctaggttgattatctccttgggagcatcacataaccatgatccaactagattgattaagttcgcttactcattagacgggtctgttcctgttactgttcgaccagtctcaactgtaccaccatacaaggaaggtcaggcttggcagcaggccgttatagaaaacggttggacctctgttattgaactaccaggtgaagtgggtactggagagcatgaattatctttatggttgcttgaacctggagttgtattacaaaagattgttttggacatgggagggtatcaagattctgcattagggagtcctgaacgtgctgtggttaccgaagctgacgtattgagagcggaagtcgttgaggaaggcagcgatatctcaccattgtctagagtctggagattgccatcttctcatgacttagatgatgatgacaaaggtggttctcctccttctcatcatcaccaccaccactaagg

SEQ ID NO: 356 - DNA, 8661 bp, Artificial Sequence
  pMU991
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgcaaagcttaaacaaaatggtctccttcacctccctcctcgccggcgtcgccgccatctcgggcgtcttggccgctcccgccgccgaggtcgaatccgtggctgtggagaagcgctcgcgagtcccaattcaaaactatacccagtctccatcccagagagatgagagctcccaatgggtgagcccgcattattatccaactccacaaggtggtaggctccaagacgtctggcaagaagcatatgctagagcaaaagccatcgttggccagatgactattgttgaaaaggtcaatttgaccactggtaccggttggcaattagatccatgtgttggtaataccggttctgttccaagattcggcatcccaaacctttgcctacaagatgggccattgggtgttcgattcgctgactttgttactggctatccatccggtcttgctactggtgcaacgttcaataaggatttgtttcttcaaagaggtcaagctctcggtcatgagttcaacagcaaaggtgtacatattgcgttgggccctgctgttggcccacttggtgtcaaagccagaggtggcagaaatttcgaagcctttggttccgacccatatctccaaggtactgctgctgctgcaaccatcaaaggtctccaagagaataatgttatggcttgtgtcaagcactttattggtaacgaacaagaaaagtacagacagccagatgacataaaccctgccaccaaccaaactactaaagaagctattagtgccaacattccagacagagccatgcatgcgttgtacttgtggccatttgccgattcggttcgagcaggtgttggttctgttatgtgctcttataacagagtcaacaacacttacgcttgcgaaaactcttacatgatgaaccacttgcttaaagaagagttgggttttcaaggctttgttgtttcggactggggtgcacaattaagtggggtttatagcgctatctcgggcttagatatgtctatgcctggtgaagtgtatgggggatggaacaccggcacgtctttctggggtcaaaacttgacgaaagctatttacaatgagactgttccgattgaaagattagatgatatggcaaccaggatcttggctgctttgtatgctaccaatagtttcccaacagaagatcaccttccaaatttttcttcatggacaacgaaagaatatggcaataaatattatgctgacaacactaccgagattgtcaaagtcaactacaatgtggacccatcaaatgactttacggaggacacagctttgaaggttgctgaggaatctattgtgcttttaaaaaatgaaaacaacactttgccaatttctcccgaaaaggctaaaagattactattgtcgggtattgctgcaggccctgatccgataggttatcagtgtgaagatcaatcttgcacaaatggcgctttgtttcaaggttggggttctggcagtgttggttctccaaaatatcaagtcactccatttgaggaaatttcttatcttgcaagaaaaaacaagatgcaatttgattatattcgggagtcttacgacttagctcaagttactaaagtagcttccgatgctcatttgtctatagttgttgtctctgctgcaagcggtgagggttatataaccgttgacggtaaccaaggtgacagaaaaaatctcactttgtggaacaacggtgataaattgattgaaacagttgctgaaaactgtgccaatactgttgttgttgttacttctactggtcaaattaattttgaaggctttgctgatcacccaaatgttaccgcaattgtctgggccggcccattaggtgacagatccgggactgctatcgccaatattctttttggtaaagcgaacccatcaggtcatcttccattcactattgctaagactgacgatgattacattccaattgaaacctacagtccatcgagtggtgaacctgaagacaaccacttggttgaaaatgacttgcttgttgactatagatattttgaagagaagaatattgagccaagatacgcatttggttatggcttgtcttacaatgagtatgaagttagcaatgcaaaggtctcggcagccaaaaaagttgatgaggagttgcctgaaccagctacctacttatcggagtttagctatcaaaatgcaaaagacagcaaaaatccaagtgatgcttttgctccagcagatttaaacagagttaatgagtacctttatccatatttagatagcaatgttaccttaaaagacggaaactatgagtatcctgatggctacagcactgagcaaagaacaacacctaaccaacctgggggcggcttgggaggcaacgatgctttgtgggaggtcgcttataactccactgataagtttgttccacagggtaactccactgataagtttgttccacagttgtatttgaaacaccctgaggatggcaagtttgaaacccctattcaattgagagggtttgaaaaggttgagttgtccccgggtgagaagaagacagttgatttgaggcttttgagaagagatcttagtgtgtgggataccaccagacagtcttggatcgttgaatctggtacttatgaggccttaattggcgttgctgttaatgatatcaagacatctgtcctgtttactatttgaggcgcgccgcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggcgctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 357 - DNA, 6123 bp, Artificial Sequence
  pMU2660
gacgaaagggcctcgtgatacgcctatttttataggttaatgtcatgataataatggtttcttaggacggatcgcttgcctgtaacttacacgcgcctcgtatcttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaacgataagtaaaatgtaaaatcacaggattttcgtgtgtggtcttctacacagacaagatgaaacaattcggcattaatacctgagagcaggaagagcaagataaaaggtagtatttgttggcgatccccctagagtcttttacatcttcggaaaacaaaaactattttttctttaatttctttttttactttctatttttaatttatatatttatattaaaaaatttaaattataattatttttatagcacgtgatgaaaaggacccaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgctttttttcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacgggcagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccaggggggaacgcctggtatctttatagtcctgtcgggtttcgccacctctgacttgagcgtcgatttttgtgatgctcgtcaggggggccgagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttacctcactcattaggcaccccaggctttacactttatgcttccggctcctatgttgtgtggaattgtgagcggataacaatttcacacaggaaacagctatgaccatgattacgccaagctcggaattaaccctcactaaagggaacaaaagctggctagagcggccgccagctgaagcttcgtacgctgcaggtcgacggatccccgggttaattaaggcgcgccagatctgtttagcttgccttgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtactactttggatgatactgcttacagatacagaacttctgttccaggtgatgctgaagctattgaagctttggatggttctttcactaccgatactgttttcagagttactgctactggtgatggtttcactttgagagaagttccagttgatccaccattgactaaggtttttccagatgatgaatccgatgatgaatctgacgatggtgaagatggtgatccagattctagaacttttgttgcttacggtgatgatggtgatttggctggttttgttgttgtttcttactctggttggaacagaagattgaccgttgaagatattgaagttgccccagaacatagaggtcatggtgttggtagagctttgatgggtttggctactgaatttgctagagaaagaggtgctggtcatttgtggttggaagttactaatgttaacgctccagctattcatgcctatagaagaatgggttttaccttgtgtggtttggatactgcattatatgatggtactgcttccgatggtgaacaagccttgtatatgtctatgccatgtccataatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcgaattcatcgatgatatcagatccactagtggcctatgcggccgccaccgcggtggagctccaattcgccctatagtgagtcgtattacaattcactggccgtcgttttacaacgtcgtgactgggaaaaccctggcgttacccaacttaatcgccttgcagcacatccccccttcgccagctggcgtaatagcgaagaggcccgcaccgatcgcccttcccaacagttgcgcagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagcgtggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 358 - DNA, 9262 bp, Artificial Sequence
  pMU2874
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggtaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaataaattagtgtgtgtgcattatatatattaaaaattaagaattagactaaataaagtgtttctaaaaaaatattaaagttgaaatgtgcgtgttgtgaattgtgctctattagaataattatgacttgtgtgcgtttcatattttaaaataggaaataaccaagaaagaaaaagtaccatccagagaaaccaattatatcaaatcaaataaaacaaccagcttcggtgtgtgtgtgtgtgtgaagctaagagttgatgccatttaatctaaaaattttaaggtgtgtgtgtggataaaatattagaatgacaattcgagatgaaattttaagcaaactctagtaggaaataagcggcttattcttgttggctcctaattctttttagtgtatcagttcccattgataaaaaaattaaaattaaaattagaaaaattaaaccagaaaaatcaagttgattaaaatgtgacaaaaattatgattaaatgctacttcaacaggattagttggcttcacccatttccctagcgaaagtcctggccagatcgcagatcgttggaatagaccctggtgttgttacatgagtttgtaccatgcctgatgtcaattgtaacagtgcatctctgcatccagcaggagattgatcgtaatctaagatgaaaacatgcatggatctcaatcgcttcgctaggacatcaagggcccatgcgaacacgttatagaggtcgccgtttggagccaacagctctggagctctgaagagagtaaagagggtgtccccaatgtgtggtcttggccctgcattactctgtggctctgcgccttgtggaggaactgcagtgccagaaagttgaccccaatcttctctccagcttccaccacattgtaagtacctaaccgtatttgccaatagtccatagacacgtcttattgccgcgagcatagctaagtccaatcgctcgccaggtctttgtctcttagccagtctatcaatatgtctatcttcaggcagagctcctaacacgatgttggtccctggcaatgtaggtggtataagtgcaacaaaagcaagcacagcctgaggagtcattgaacccattaggtatctggcagcaggataacaaagcaatgccgcgattgggtgtctatcgaatatcaatgtgagtgctggtggtggggcatgacttgaaccagcttctccgccaatatgtggggccaaaacagcatcagttacggcgtaaggcatgcccatggttatctgtgcagaagtcataacaacagccgcatcaccagcggagatttcaccttgatctaatctatgttgggtggtgtagatgtttgcgatcgtttctgaggcacctagaactctccagtaggtcataggctctggaacatagacaatatcatctctagatcccaaagcgactagtaattgtgtagttgttgttttacccataccgtgtggaccgtcgatgtagactctaagtagtgttggcatcttttgttctggtcttacttcagttgcttcctgttgtctacgaggacgcaaagctgttctcctattagaatgtcctctagatctcgcggcttgatcaaaagcggatgcatgttggtgaccaggatatgaagccattttttgattaaaattaaaaaaactttttgtttttgtgtttattctttgttcttagaaaagacaagttgagcttgtttgttcttgatgttttattattttacaatagctgcaaatgaagaatagattcgaacattgtgaagtattggcatatatcgtctctatttatactttttttttttcagttctagtatattttgtattttcctccttttcattctttcagttgccaataagttacaggggatctcgaaagatggtggggatttttccttgaaagacgactttttgccatctaatttttccttgttgcctctgaaaattatccagcagaagcaaatgtaaaagatgaacctcagaagaacacgcaggggcccgaaattgttcctacgagaagtagtgggtcataaaaagtttattccctggaaaaaaaattttgcgttgcctttctgggcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 359 - DNA, 39 bp, Artificial Sequence
  X11631
ttgccaaagtggattctcctactcaagctttgcaaacat

SEQ ID NO: 360 - DNA, 41 bp, Artificial Sequence
  X11632
tagctatgaaatttttaactctttaagctggctctcatcaa

SEQ ID NO: 361 - DNA, 27 bp, Artificial Sequence
  X11633
agcacgcagcacgctgtatttacgtat

SEQ ID NO: 362 - DNA, 33 bp, Artificial Sequence
  X11634
tagcccttggttgagcttgagcgacgttgaggt

SEQ ID NO: 363 - DNA, 19 bp, Artificial Sequence
  X13185
aaaggatttgcccggacag

SEQ ID NO: 364 - DNA, 20 bp, Artificial Sequence
  X13188
ccagcaaatgctagcaccac

SEQ ID NO: 365 - DNA, 20 bp, Artificial Sequence
  X13680
cacccacacatttctcatgg

SEQ ID NO: 366 - DNA, 20 bp, Artificial Sequence
  X13681
cacacatgagtcgtcgcacg

SEQ ID NO: 367 - DNA, 21 bp, Artificial Sequence
  X13682
cggaagaggttttgtcatcac

SEQ ID NO: 368 - DNA, 19 bp, Artificial Sequence
  X13684
gctcgggaatccgctgtgg

SEQ ID NO: 369 - DNA, 89 bp, Artificial Sequence
  X16143
cgcgcgtttccgtattttccgcttccgcttccgcagtaaaaaatagtgaggaactgggttaccccttaaagagttaaaaatttcatagc

SEQ ID NO: 370 - DNA, 46 bp, Artificial Sequence
  X16146
tagctatgaaatttttaactctttaaggggtaacccagttcctcac

SEQ ID NO: 371 - DNA, 21 bp, Artificial Sequence
  X16151
atgttgttgcaagcttttttg

SEQ ID NO: 372 - DNA, 60 bp, Artificial Sequence
  X16152
tcaagttttgaatccatggtactctcaatgcttataatttgcgaacacttttattaattc

SEQ ID NO: 373 - DNA, 60 bp, Artificial Sequence
  X16153
tataaaattaaatacgtaaatacagcgtgctgcgtgctcatagatgcattgtgaaaattg

SEQ ID NO: 374 - DNA, 60 bp, Artificial Sequence
  X16154
aattagagcgtgatcatgaattaataaaagtgttcgcaaattataagcattgagagtacc

SEQ ID NO: 375 - DNA, 60 bp, Artificial Sequence
  X16156
ttgatgagagccagcttaaagagttaaaaatttcatagctactacttggcttcacatacg

SEQ ID NO: 376 - DNA, 60 bp, Artificial Sequence
  X16157
caaaaccagccaacaaaaacaaaaaagcttgcaacaacattttgaatatgtattacttgg

SEQ ID NO: 377 - DNA, 89 bp, Artificial Sequence
  X16192
tgcccctgagctgcgcacgtcaagactgtcaaggagggtattctgggcctccatgtcgctggccgggtaaatacagcgtgctgcgtgct

SEQ ID NO: 378 - DNA, 41 bp, Artificial Sequence
  X16193
agcacgcagcacgctgtatttacccggccagcgacatggag

SEQ ID NO: 379 - DNA, 89 bp, Artificial Sequence
  X16194
ttattcatttgaaatataaaatttgggcttctatattttaatattgcttttcaattactgttattaaaaaatacagcgtgctgcgtgct

SEQ ID NO: 380 - DNA, 44 bp, Artificial Sequence
  X16195
agcacgcagcacgctgtattttttaataacagtaattgaaaagc

SEQ ID NO: 381 - DNA, 89 bp, Artificial Sequence
  X16196
gcgactctctccaccgtttgacgaggccatttacaaaaacataacgaacgacaagcctactccttaaagagttaaaaatttcatagcta

SEQ ID NO: 382 - DNA, 50 bp, Artificial Sequence
  X16197
tagctatgaaatttttaactctttaaggagtaggcttgtcgttcgttatg

SEQ ID NO: 383 - DNA, 19 bp, Artificial Sequence
  X16549
aaaggatttgcccggacag

SEQ ID NO: 384 - DNA, 19 bp, Artificial Sequence
  X16550
gggtaacccagttcctcac

SEQ ID NO: 385 - DNA, 18 bp, Artificial Sequence
  X16551
gagtaggcttgtcgttcg

SEQ ID NO: 386 - DNA, 20 bp, Artificial Sequence
  X16552
ccagcaaatgctagcaccac

SEQ ID NO: 387 - DNA, 68 bp, Artificial Sequence
  X16553
ccgcttccgcagtaaaaaatagtgaggaactgggttaccccgatttttttctaaaccgtggaatattt

SEQ ID NO: 388 - DNA, 60 bp, Artificial Sequence
  X16554
ccaaagttagttagatcagggtaaaaattatagatgaggttttcaatcattggagcaatc

SEQ ID NO: 389 - DNA, 69 bp, Artificial Sequence
  X16555
tggtgcggtccatgtaaaatgattgctccaatgattgaaaacctcatctataatttttaccctgatcta

SEQ ID NO: 390 - DNA, 65 bp, Artificial Sequence
  X16556
tggaagctcggatcagtagataacccgcctagaagactaggttacattgaaaatacagtaaatgg

SEQ ID NO: 391 - DNA, 63 bp, Artificial Sequence
  X16557
cataataatggtggaaccatttactgtattttcaatgtaacctagtcttctaggcgggttatc

SEQ ID NO: 392 - DNA, 60 bp, Artificial Sequence
  X16558
tcaaggagggtattctgggcctccatgtcgctggccgggtgcaaagaggtttagacattg

SEQ ID NO: 393 - DNA, 58 bp, Artificial Sequence
  X16559
ttctaagctcaatgaagagccaatgtctaaacctctttgcacccggccagcgacatgg

SEQ ID NO: 394 - DNA, 63 bp, Artificial Sequence
  X16560
gttctaagctcaatgaagagccaatgtctaaacctctttgctttaataacagtaattgaaaag

SEQ ID NO: 395 - DNA, 60 bp, Artificial Sequence
  X16561
ttctatattttaatattgcttttcaattactgttattaaagcaaagaggtttagacattg

SEQ ID NO: 396 - DNA, 63 bp, Artificial Sequence; identical to SEQ ID NO: 391
  X16562

SEQ ID NO: 397 - DNA, 66 bp, Artificial Sequence
  X16563
gtggaagctcggatcagtagataacccgcctagaagactaggttacattgaaaatacagtaaatgg

SEQ ID NO: 398 - DNA, 70 bp, Artificial Sequence
  X16564
ttggtgcggtccatgtaaaatgattgctccaatgattgaaaacctcatctataatttttaccctgatcta

SEQ ID NO: 399 - DNA, 60 bp, Artificial Sequence; identical to SEQ ID NO: 388
  X16565

SEQ ID NO: 400 - DNA, 69 bp, Artificial Sequence
  X16566
cgaggccatttacaaaaacataacgaacgacaagcctactccgatttttttctaaaccgtggaatattt

SEQ ID NO: 401 - DNA, 21 bp, Artificial Sequence
  X17388
atggtctccttcacctccctc

SEQ ID NO: 402 - DNA, 60 bp, Artificial Sequence
  X17389
aataagcagaaaagactaataattcttagttaaaagcacttcaaatagtaaacaggacag

SEQ ID NO: 403 - DNA, 60 bp, Artificial Sequence
  X17390
tgttaatgatatcaagacatctgtcctgtttactatttgaagtgcttttaactaagaatt

SEQ ID NO: 404 - DNA, 60 bp, Artificial Sequence
  X17391
tatataaaattaaatacgtaaatacagcgtgctgcgtgctgaaaaagccacgcgtgtgca

SEQ ID NO: 405 - DNA, 63 bp, Artificial Sequence
  X17395
tggcggcgacgccggcgaggagggaggtgaaggagaccattttgtaattaaaacttagattag

SEQ ID NO: 406 - DNA, 59 bp, Artificial Sequence
  X17396
tgatgagagccagcttaaagagttaaaaatttcatagctacgtcaagggggcataagac

SEQ ID NO: 407 - DNA, 60 bp, Artificial Sequence
  X17624
gtataactccatgctatacaaccacagcggattcccgagcgaggtttagacattggctct

SEQ ID NO: 408 - DNA, 60 bp, Artificial Sequence; identical to SEQ ID NO: 407
  X17624

SEQ ID NO: 409 - DNA, 60 bp, Artificial Sequence
  X17625
tcaaggagggtattctgggcctccatgtcgctggccgggtcttctaggcgggttatctac

SEQ ID NO: 410 - DNA, 60 bp, Artificial Sequence
  X17626
cctagtggaagctcggatcagtagataacccgcctagaagacccggccagcgacatggag

SEQ ID NO: 411 - DNA, 60 bp, Artificial Sequence
  X17629
gaaatctttagatttactggcgtgcgacgactcatgtgtgtttcaatcattggagcaatc

SEQ ID NO: 412 - DNA, 60 bp, Artificial Sequence
  X18179
tatcgatgctgtgtggtgtcatttaattaatgtatatgagatagttgattgtatgcttgg

SEQ ID NO: 413 - DNA, 60 bp, Artificial Sequence
  X18180
ataccaagcatacaatcaactatctcatatacattaattaaatgacaccacacagcatcg

SEQ ID NO: 414 - DNA, 60 bp, Artificial Sequence
  X18181
aactttaactaataattagagattaaatcgcggcgcgccttagtggtggtggtgatgatg

SEQ ID NO: 415 - DNA, 60 bp, Artificial Sequence
  X18182
ctcatcatcaccaccaccactaaggcgcgccgcgatttaatctctaattattagttaaag

SEQ ID NO: 416 - DNA, 60 bp, Artificial Sequence
  X18206
atccgaaatattccacggtttagaaaaaaatcggttcgaagaaggatgttattatatgat

SEQ ID NO: 417 - DNA, 60 bp, Artificial Sequence
  X18207
cagagatcatataataacatccttcttcgaaccgatttttttctaaaccgtggaatattt

SEQ ID NO: 418 - DNA, 59 bp, Artificial Sequence
  X18362
ccccccgtttcttttctttggactatcatgtagtctcgctagagaataaattcaagtta

SEQ ID NO: 419 - DNA, 59 bp, Artificial Sequence
  X18363
ttcaacatcatcttttaacttgaatttattctctagcgagactacatgatagtccaaag

SEQ ID NO: 420 - DNA, 59 bp, Artificial Sequence
  X18402
tattccctggaaaaaaaattttgcgttgcctttctggtcgacactggatggcggcgtta

SEQ ID NO: 421 - DNA, 60 bp, Artificial Sequence
  X18403
gctgtcgattcgatactaacgccgccatccagtgtcgaccagaaaggcaacgcaaaattt

SEQ ID NO: 422 - DNA, 38 bp, Artificial Sequence
  X18578
aggtcctcatcaaggaggtcaccagtaattgtgcgctt

SEQ ID NO: 423 - DNA, 59 bp, Artificial Sequence
  X18579
aaggaaaggaaaataattgaaggaggaggcagagaacctacttattcccttcgagatta

SEQ ID NO: 424 - DNA, 59 bp, Artificial Sequence
  X18582
atgggttcctagatataatctcgaagggaataagtaggttctctgcctcctccttcaat

SEQ ID NO: 425 - DNA, 60 bp, Artificial Sequence
  X18583
gaggtcaccagtaattgtgcgctttggttacattttgttgtacagtaatgggcggtcaag

SEQ ID NO: 426 - DNA, 58 bp, Artificial Sequence
  X18584
cgctggccgggtgacccggcggggacaaggcaagctgttctctgcctcctccttcaat

SEQ ID NO: 427 - DNA, 59 bp, Artificial Sequence
  X18585
aaggaaaggaaaataattgaaggaggaggcagagaacagcttgccttgtccccgccggg

SEQ ID NO: 428 - DNA, 59 bp, Artificial Sequence
  X18586
gtgtatatgcctgttcattgcctgtccgcctctcattgttttgatttggttcccagaaa

SEQ ID NO: 429 - DNA, 59 bp, Artificial Sequence
  X18587
gtgtatatgcctgttcattgcctgtccgcctctcattaaattagtgtgtgtgcattata

SEQ ID NO: 430 - DNA, 59 bp, Artificial Sequence
  X18588
tgctcataccctttgtttctgggaaccaaatcaaaacaatgagaggcggacaggcaatg

SEQ ID NO: 431 - DNA, 60 bp, Artificial Sequence
  X18589
actaatcaaagtcaaacacgactctcagccatttattaagttcctcaattttcgccctcc

SEQ ID NO: 432 - DNA, 59 bp, Artificial Sequence
  X18590
ttaatttttaatatatataatgcacacacactaatttaatgagaggcggacaggcaatg

SEQ ID NO: 433 - DNA, 38 bp, Artificial Sequence; identical to SEQ ID NO: 422
  X19747

SEQ ID NO: 434 - DNA, 22 bp, Artificial Sequence
  X19748
gttctctgcctcctccttcaat

SEQ ID NO: 435 - DNA, 22 bp, Artificial Sequence
  X19751
aatgagaggcggacaggcaatg

SEQ ID NO: 436 - DNA, 60 bp, Artificial Sequence; identical to SEQ ID NO: 431
  X19752

SEQ ID NO: 437 - DNA, 60 bp, Artificial Sequence
  X19790
aggaaaggaaaataattgaaggaggaggcagagaaccgcacagatattataacatctgca

SEQ ID NO: 438 - DNA, 60 bp, Artificial Sequence
  X19797
ttattcttcttaataatccaaacaaacacacatattacaataatgcatcggtggcaattg

SEQ ID NO: 439 - DNA, 60 bp, Artificial Sequence
  X19798
aaatttttttggtttatgtccaggttggagatttcctttagtggtggtggtgatgatgag

SEQ ID NO: 440 - DNA, 60 bp, Artificial Sequence
  X19799
aaggtggttctcctccttctcatcatcaccaccaccactaaaggaaatctccaacctgga

SEQ ID NO: 441 - DNA, 60 bp, Artificial Sequence
  X19800
atgcctgttcattgcctgtccgcctctcattataaaaattcttgttaaatatttcaggaa

SEQ ID NO: 442 - DNA, 60 bp, Artificial Sequence
  X19808
aaacaagccctagaagcaattgccaccgatgcattgttttatatttgttgtaaaaagtag

SEQ ID NO: 443 - protein, 42 aa, Artificial Sequence
  codon-optimized flexible linker sequence, optimized linker 1
GGGGSGGGGSAWHPQFGGENLYFQGDYKDDDKGGGGSGGGGS

SEQ ID NO: 444 - DNA, 144 bp, Artificial Sequence
  DNA sequence of codon-optimized flexible linker 1
ggaggaggtggttcaggaggtggtgggtctgcttggcatccacaatttggaggaggcggtggtgaaaatctgtatttccagggaggcggaggtgattacaaggatgacgacaaaggaggtggtggatcaggaggtggtggctcc

SEQ ID NO: 445 - protein, 37 aa, Artificial Sequence
  codon-optimized flexible linker sequence, optimized linker 2
GGGGSGGGGSWSHPQFEKGGENLYFQGGGGGSGGGGS

SEQ ID NO: 446 - DNA, 117 bp, Artificial Sequence
  DNA sequence of codon-optimized flexible linker 2
ggtggcggtggatctggaggaggcggttcttggtctcacccacaatttgaaaagggtggagaaaacttgtactttcaaggcggtggtggaggttctggcggaggtggctccggctca

SEQ ID NO: 447 - DNA, 8795 bp, Artificial Sequence
  pMU3150
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcggtggcttctcacctcgtccgcactgttagtgccggccgcagccttggttagacctgacggagtcggcttaaccccagctttaggatggaactcatggaatgcctactcttgtgatattgatgctgacaaaatagtcactgcagctaatgaggttgttaatttgggtttaaaagatttgggctacgaatacattaacatcgatgactgttggtctgttaagtccgggagaaacactactacaaagagaatcatccctgatccagacaaattcccaaatggcatttcaggggttgcagatcaagttcatgccttggggttgaaattaggcatatactcatcagccggattgacaacttgtgctggttatccagcttctcttgggtacgaagagatcgacgcacaaagtttcgctgaatggggtatcgattacctaaagtacgataattgtggtgtccctacaaacctaacggatcagtatacttattgtgttcctgatagcactgatggttcaaattatccaaatggtacctgcgtaaacttaactgatgctgcaccacagggctacgactgggcgaccagtacaacagctaagagataccaacgtatgagagatgcgcttttgtcagttaatagaaccatactatactccctatgcgattggggtcaagcagatgtaaacgcttggggaaatgctacaggcaattcatggagaatgagtggtgacatcacagctacttggtctaggattgctgaaatagcaaacgaaaacagctttctgatgaattacgcgaacttttggggatatccagatcctgatatgttagaagtcggaaatggaaatcttacattaccagaaaacagagcacatttcgcactgtgggcaatgatgaaagctccattgatcattggtactcctctcgattctatcgacacatctcatctcacaattctgtccaataagccattgcttacgtttcatcaagacgctgtgattggtaggccagcttatccatacaaatggggttacaatccagattggacttttgacccagagcatcctgccgaatactggtctgggccaacatcttctggagaagtctttgtccttatgttaaactcagagggagaagtaaagacaagatcagccgtttgggaggaagtaccagaattgaaagacagaggcactaagaaaaattccaaagagaaaaagggcttcaaagtgacagatgcctggactggcaaggatctaggttgtgtaaaagacaaatacgaagttaagctacaagctcatgatgtagccgtgttggtggttggtggtcaatgcgatgatgatgacaaaggtggttctcctccttctcatcatcaccaccaccactaagg

SEQ ID NO: 448 - DNA, 9341 bp, Artificial Sequence
  pMU3151
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaactatataatagacgatctcgacaaaatggccagactctttgccactgccattgccattacaggtgctcttgctcaaactaattgtacaggctctagttacgttcctggttctgttaatttcacactagaatgttacaacgcaatacaaaattgtgtctcaaagtttgaggctaacgcttctctggtagattgcaatgatggccagggtaacatctacatgcaacaacaagcctcattgacatcaacctcaccaaattccgatattgtcatcgctttccaagatatcctcgaactttgcatactatctggatctaccagcggcacgtggggctattccgacaatcaatggtactggaccgctgcggaaccagcatgttacgtcgattcaacaacagatgtagttcctacaaggccagccccattctgtatacaagaccgtgactcatctttgcctgactgctatcctcagccaaaatcaatagctagttccgcaaataagtttaaagtcttaaaaacttctggttcaacacctaatggcttcaatagttcagccagaggatggaacacgtacggtattcaagcactatctaatggttctgaagtggtaccatcatttgttggtagttctggacttaactacttacaggaatttgtcaagacacaatgtggggttttagctcaaagtggatttcaacaagcgggatacgtttactgttcattggattcaggttggcaaactcaaacaactgatgagtatgggagaatcgtgtacgattctaccagattcaatctccctcaattggcatcatggttgcatggacaaggcctgaaacttggtgtttatgttgttccaggagtgccatgcagtgctgcgaataagactattaaaggtactaatatctctattaatgatgcattgaacggtaataacgatcaactgtactgttcctggaactttagtaaggatggagtacaggagtggcatgactcagtggttgctcagtgggcaagctggggtgttgatatgattaaactagacttccttacaccaggtagtccacaaaatggtgctaatttggactgcgattcatccgacgctgcccatgcttacttgaatgcaatcaaggcgtctggtagacacatgagattggatctgtcttggaaattgtgtagaaatgaaacatggctaccaatatggtcccagttaggcgattcaatgagaattgaccaagatttggataactacggttacaacacatttgtggcttgggcgactgcccaaagagcaatcgacaattacagacaatacatcggactacaggctcagagaaatgtcccattaaccacttacccagatatggataacttgtttacagcaaacgccgagaacttaactggtgtcccagacttacaaaggatcaccatcatgaatcattggttaggggctggagccaatcttattctcggaggggatttgacagcaattgactctttaggctatcagttgctaacatctgcagaatccatcgctgcagctgactttttctctcaataccctatgcaaccacgaaacccaagcacaggtgataacttagcacaacaactgcaggcctggatcgcaggcccatccgatgattctatcgcttatgtgttgctagtgaactatggccctgaccaaggacaaggtggttttggcacacaacttaagggtatccaagatgtaacggtttcattagaagatttgggcatttcaggctcctcttggcacgctactgatctttggaatgggactgctacgaaaattactgattcctacacagtagcattggacgaaggtgcttctcaattattgagattaactactgcttctgatgatgatgacaaaggtggttctcctccttctcatcatcaccaccaccactaagg

SEQ ID NO: 449 - DNA, 8639 bp, Artificial Sequence
  pMU3217
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgatgaaacgcaaatctcagctgtcatcattcaccttagtgacggcggcaattttaccttttgcccattttgtgatgggaggcacaagtctcgcacagaagccacaaatgggttggaatagctggaatgcctttaaagctacagtcaattacactatcgttcaggaggttatttccctgtttgatacgttaggactaaaggaagccggatatgaatacgttctactggacgatggttgggcatcttacaatagaacatcagatggttacctacaagctaatgcgacttcatttccacaaggcataaaggctttggcacaagaggtacatggtaaaggtcttaagttaggcttgtacggcgactctggacattacacttgtgcttggcgtccaggctcttggggttacgaggaaagagatgcacaaacatttgccggttggggtgtcgattacctaaaatacgacaattgtgggggctttcaaagtatgaccgaagcccctcaaattaggttcggtgcaatgaaaaatgccttaactttgtctggtagagatatattctattccgtatgcggctggggatatcaatttccttggcattggggtggcgatatcggtcatagttacagaatgtccggagacattactacttcattcacaaacgaaaccgaatgccaatgtaagaccgcttattgtttgaatacaggacaataccaaactccagggcattggctggatatggacatgttagaagttggtaatgctaacttcacacttaatcaacaacaaactcattttgctttttgggctgcactgaaatcaccactaatcataggggcagacttgagcaaattgagtaacgattctcttgctgttctcacaaacaaggccatcatttctatcaaccaggatgcattgggggaaccagtaacttatagagaagctcactccaaagagggtttgttccaagtttgggctgggaaggtcgaagatggctacgtggtattgctccttaacgaaaaatcatacccacaaacagtttcattgtcattcgcatctttaggtttgggatctccacagaaagtcacagagttatggtctggacaaacattgcaggatcttagtatgatatccgctaatccacaatctagacaaattgacatcctaaacatcaaggatgatgatgacaaaggtggttctcctccttctcatcatcaccaccaccactaagg

SEQ ID NO: 450 - DNA, 9707 bp, Artificial Sequence
  pMU3218
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgggacaagtgccggctctttgtaggttgactgtcttgctcctggtcgctggcatggcgtcggctgcgagtgctcaaggtggctcacaaaaacctatcgaagttgatggtacgacattcgctcttaatggggataatgtctcctacagatttcatgtagatactacaactggcgacttgattggcgatcactttggcggacctgtagagtcagatacaatagaagctgaaatcggtcctgttcagggttgggtagacatgatcggcagagttagaagagaactcccagacttgggtagaggtgactttcgaacaccagttgtacaaattagacaatctgaagggtacaccgtgtctgattttcagtaccaagggcatactgttctagaaggcaaaccagcattgaatgggcttccatccacattcggaaaggatgaagatgtgtctactttagtagtacatctttatgataattactcttccgttgctgcagaccttggttactccatttttccaaagtacgacgccattgtccgttctgtgaacatcacaaattctggcgagggaaacattactatcgaaaaattggcatcttttagtgttgatctgccttggggtgattatgatatgttggagttgaagggggattgggctagagaaggtatgagaatacgtcgtaaaattgactttggaatccaaggattcggttccactacaggatacagttctcatctgtataatccattcctgagcgtcgtatccggagctactactgaatcacatggggaagcatacgggttttcacttgtctatacaggctcattttcagcagaagttgaaaaatcttctcagggcctcaccagagcaatgctgggtttcaacccatcccaattagcttggccattaggaccaggtgaatctctccaatctccagaatgcgtggcaatcttttcctccactggtattgggggaatgagtagaaaattgcatagtttatacagacaacacttaatgaagagtaagtacgctacagaaacaagaccagtcctacttaattcctgggaaggtttaggtttcaactataacgccagtacaatatacagattagcccaacaatcagcggaacttggtgccaagctattcgtgttagatgatggctggtttggcgtgaaacatcctagaatctctgacaatgcaggtttgggtgactgggaggttaatccaaaaagatttccagatggtctggaggctttagtcgataaagtaactgctttaccagtaggcaattctagtaccaaattgagatttggtttatggtttgaaccagaaatggtgaatcctgattcatctttgtatgaggaacatccagattgggccctacatgcaggaaaatatcctagatcattgactaggaaccaattagtactcaacgttgccttacctaaagttcaagacttcatagttgacgctgtctcaaatatcttaaagtcatcaaatattgcttacgttaagtgggataacaatagaggtatccatgaaaccccaacaccacacacagatcaccaatacatgttgggtttgtacaaggtgttcgccaggttgaccgagcgtttcccagacgttatatgggagggctgtgcatcaggaggtggtagatttgatcctggtgtcttacagtactttccacagatatggacatcagatgatacggatgcggttgagagaatatacatccaatttggcacctcacttgtatatccaccaagcgctatgggagcccatgtttctgcaacacctaattctcaatctggcagaaacgaaacaatcgagttcagagcacatgtggctatgatgggcggttccttcggtttggaattggacccttctcacatgcctgaacaagacaaagccaaagttccagaccttatcaaattggctgagaaagtcaaccctattgttgtcaagggtgacatgtggagattgaggctgccagaagagtcagactacccagcagcactattcatttcagaagatggagaacaggccgttctcttttactttcagctaaaaccaactattaacaattactggcctgtagttagattacaaggcctagatgctaaagcgatgtataaggttgatggtgtgcaaacggtttccggagcaactctaatgaatagaggagtatcttacaactttgaagccggttactcttctaaggtggtgtttttcgagaagcaagatgatgatgacaaaggtggttctcctccttctcatcatcaccaccaccactaagg

SEQ ID NO: 451 - DNA, 9707 bp, Artificial Sequence
  pMU3152
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgatcgggtcttctcatgccgtggtggccctgggcctttttacgttatacggtcattctgcagcagccccagcaattggcgcatcaaacagccagactatagttaccaatggtacatcatttgcattgaatggtgacaatgtttcataccgattccacgttaatagttctaccggggatttgatatctgaccatttcggaggagttgtaagtggcactattccatctcctgtagagccagcagttaatggttgggtaggaatgcctgggagaattagaagagaatttccagaccaaggtagaggggacttcagaataccagctgtcagaatcagagaatcagcgggatacacggtttccgacttacaatacgtttcccatgaagtcatcgaaggcaaatacgctctacctggtttgccagcgacgttcggtgatgctcaggacgctactacattggtagtccacctgtacgataattactcctctgtcgctgcagatttgtcctattcaatatttcctaagtacgatgctattgtgagaagtgtcaatgtaacaaatcaaggtccaggtaacattacaatcgaagctctagcctcaatatcaatcgattttccttacgaagatttggacatggtcagcctaagaggtgattgggctagagaagctaatgttcaaagatcaaaagtgcaatacggagtgcaaggttttggaagttctactgggtattcatctcatctgcataacccatttctcgccattgttgatcctgcgacaacagaatctcaaggtgaagcctgggggtttaacttagtatacaccgggagtttttcagcacaagttgaaaagggctcacaaggttttacaagagctttactaggtttcaatccagatcagttaagttggaacttaggtccaggagaaactttaacatcccctgaatgcgtcgcagtttacagcgataaaggcctaggctcagtctctagaaaatttcatagactctacagaaatcatctaatgaaaagtaagtttgcaacttctgatcgtccagtattactgaatagttgggaaggtgtttactttgattacaatcaatcaagcatcgagacactagctgaggaaagcgctgctttgggcgtccatctgtttgtaatggacgatggctggttcggagacaagtatccacgtgtaagtgacaatgctggattgggagattggatgccaaaccctgccagattccctgatggtctaacaccagtggttcaagacatcacaaacttgacggttaatggcaccgagtctacaaaactcaggttcggaatctgggttgaaccagaaatggtgaatccaaactctactttgtatcatgaacacccagagtgggccctgcacgctggtccatacccacgtaccgagaggagaaatcaattggttttaaacttggcattaccagcagtgcaggattttatcatcgatttcatgacaaatctacttcaagacactggcatttcctatgttaagtgggataataacaggggaatacatgagactccatctccatccactgaccatcaatacatgttgggcctgtacagagtttttgatacattaacaacaagattcccagacgttttgtgggaagggtgtgcatcaggaggtggtagattcgatgctggaatgcttcaatatgtcccacaaatctggacttctgataatactgacgctattgatcgtattacaattcaattcggtacttccttagcgtatcctccatcagcaatgggtgctcacttgtctgcagttcctaacgctcaaacaggcagaactgttccttttaccttcagagcccatgtggccatgatgggaggttcatttggattagaacttgacccagcaacagtcgagggtgatgaaattgttcctgagttgttggctttggcagaaaaagtcaacccaatcatccttaacggtgatttgtacagactcagattacctcaggattctcagtggccagctgcactttttgtttctcaggatggtgcccaagctgttctcttttacttccaagtacaaccaaacgtgaaccatgccgtgccttgggtaagacttcaaggcttagatcctaaggctgactatactgtagatggtgatcaaacttattctggcgccactcttatgaatttgggtttacaatactcctttgataccgagtacggctcaaaagtcgtgttcctcgaaagacaagatgatgatgacaaaggtggttctcctccttctcatcatcaccaccaccactaagg

SEQ ID NO: 452 - DNA, 9725 bp, Artificial Sequence
  pMU3153
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggttggcatgaaggctgtttacacgttgagcctgctggccggcgtcgctgttggacaaaacgggaaatcaattaaagcagctggtacaaatttcactttgacagctgatggaatgtcttatttgtttcatgtggatacagctacaggtgatctaatatctgatcattttggtggtccaacaactgacttcaccccaccagcgaagataaacccttctggatgggtggacaaattaggaaatactagaagagaatttccagatatcggaagaggtgattttagattgccagcgattcatattcaacatgcagatggagatacagtcactgcctttcgttaccaatcccatgaaattatcaacggaaagcctggcctaccaaaactaccagccacttacggagaagcaggcgacgttacaaccgttatagtacacatgtacgataatatctcagatgtctctgcagctttgtcttactctatttttcctagatataatgctatcgctagaagtttcagcatatctaataatggatcatccgatattgttatcgaaagagcatctagcttttcaactgatttgccaaatgttgagctagatatgatcgaaccatacggtgattggtctagggagtttcagactgtaaaaaggaaaatcgattacggtgaaacaactttcagatcaacagctggttacgcttcacatatccataacccatttttcacattggtttcaccaactactaccgagtctacaggggaagcctggggcttcagtctcgtgtggacaggttcctttacagcaacggctcaaagattcgctaacggttacgtcagagtgttaatgggtcttaattcacttcatgcctccattagagtagctccaggagctacgtttcagtccccagaagctgtgggtgtctactcctctaacgggataggcggaatgtcaagatcattccacgacttgtacagaaatcacttatcaagatccaagtttacttcccaaactcgaccaatcttactcaattcatgggaaggacttggtttcaagatcaatgaaactgccttagtgaatcttgctggtgaggcagaggaaattggaatcgaattgtttgttatggatgacggctggtttggtgtagaatatccaaggaacaacgacactatgggcttgggggattggactccaaatccagccaaatttccatcagggcttagaccatacgtggaaaaagtgaataagtttaacgttttgaactctacaacaccattacaatttggtatatgggtcgaacctgagatggtaaaccaaaactctactttatacaaggaacatcctgattgggttttacatgctggtaagcatgagagaacagttactcgtacacaacttgttttgaacgttggcttaccagaagtacaagacttcatcattgattctgtttcaagagtccttgattctgccaatatacaatatgtcaaatgggacaataatagaggtatccatgaactcgcaagaccttctgatgactacacctacatcctgggattatacagagtcattgacacacttacaacaaaatatcctaatgtgctattcgaaggttgtgcttcaggagggggaagatttgatcctggccttctccactactggagccaacattggacctctgacaatacagatgcctctaatcgactgaccatccaaatgggcacttccctggtatacccaccatctgcaatgggctgtcacatctctgctgttcctaaccatttgaccaaaagatccatttctattgaatatagaggtcatgtagcgatgatgtgtggatcattcggtctggaattaaacccatccgaactctccgctgaggagactgcactactgccaagtctaatggccgaagctaaagcaattaatcctattgttatatcaggtcacttctataggttagctcatcctgatgtatctaactggcctggggtacagttcgttagtgccgatgggacacaggcggttgtttttgcgtttcaacaattgtacatggtcaagccagccgcaccacctctaaaactacaaggtttggacccaaaagcacgttacagtaatgaccttgacaacggtacttatagtggagccacctacatgaacggcggtttgaatattccttggccacagggtgattatcaatcaaagataatctggttgaatagagtcactgcaaatggtagtcaagcaagagaagcacctatctgcgatgatgatgacaaaggtggttctcctccttctcatcatcaccaccaccactaagg

SEQ ID NO: 453 - DNA, 8822 bp, Artificial Sequence
  pMU3154
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcttcatcgtgctactaccactgctgccgcggcggcagcagcagcgttattactttgcccagtccaggccttagttagaccagatggtgtgggaaagctaccagcattgggctggaactcctggaacgccttcggttgtgacatcgatgaagagaaaattctaacagctgcaaatcaaatcgtgaacttgggcctgaaagaccttggatatgaatacgtgaatattgatgattgttggtctgtgaaaagtggtagaaatgctacaacaggaaggattatgccagatttgacaaaatttcctgatggaatcagtggtttagctgaaaagatccataatctaggattgaaaatcgggatatacagctcagccggttggactacctgcgctggttacccagcttctctggggaatgagacaatagacgccgaaacattcgctgaatggggtattgattacttaaagtacgataattgtggtgttcctcctgattggcaggatcaatactcatattgcgtcccagactctggtgatccagctacaaacccaaatggcacttgtcctaatttgcaaaacccagctcctgccgtatatgactggagaacaagtaaaacggccgaaagatacagacgaatgagagatgcattgctaggcgttcaagataagagaaccattctattttccttatgtgattggggtcaagctgatgtcaacgaatggggtgcagagacaggtaattcatggagaatgtctggagatatatcaccaaattggccacgtatctccacaattgcaaaccttaattccttcgaacttaattccgttgacttttggggacataacgatcctgacatgttggaagtagggaatggtaatctcactctcgcagaaaatagggcccatttcgctttgtgggcagctatgaaatcaccactcatcatcggcacagcgttggacaagatcgatcaggatcatctgtctattttgagtaataagtacttgttgacctttcaccaagacccacaaataggcagaccagcatatccttacaagtggggttacaatccagactggacatttgatcctggccatccagctgaatactggtctgggccaactagctctggcgacgttctggtactcatgttaaacactgagtctggacctgctaacagaactgccgtctggtctgaagtaccagagctaaaaggtagaaacaacaacaataattcatcatctactggatttcaagtaacggacgcatggactggatcatcacttggctgtgttcaaggtggttatagcgttgagttagaatctcatgatgttgctgtcttagttgtgtcaggggaatgcgatgatgatgacaaaggtggttctcctccttctcatcatcaccaccaccactaagg

SEQ ID NO: 454 - DNA, 9101 bp, Artificial Sequence
  pMU3155
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgatacagggacttgagagcatcatgaatcaaggaaccaagcgtatactactggctgccacgctagcagccaccccctggcaagtctacggctcaattgaacaacctagtctgttaccaacacctccaatgggctttaacaattgggcaagattcatgtgcgacttaaacgagacattgttcacagaaaccgctgatactatggctgccaatggcttgagagatgctggttacaatagaattaaccttgatgattgctggatggcgtaccaaagatcagacaatggtagtctccaatggaatactacaaaattcccacatggtttgccttggttggcaaaatatgttaaagctaagggtttccatttcggcatctacgaagattccggaaatatgacttgtggtggttacccaggaagttataatcatgaggaacaagacgctaatacattcgcctcctggggtattgactacttgaaactagacggttgtaatgtttacgcaacgcagggccgtacgctcgaagaggaatacaaacagcgatatgggcattggcatcaggtactttcaaaaatgcaacatccattgatattttctgaatctgctccagcatatttcgcaggcacagataacaatactgactggtatacagtaatggactgggtaccaatctacggagaactggccagacactccactgacattctggtgtacagtggagctggatcagcttgggattccatcatgaacaactacaattacaatacattgttagctagatatcaaagaccaggatactttaatgatccagattttctgatccctgatcaccctgggcttactgccgacgaaaagagatcacattttgctttatgggcttccttttcagcaccattgatcatctctgcctacattcctgctttgtctaaagatgaaatcgcatttctgactaacgaagcattaattgcggtgaatcaagatcctctagcgcaacaagcaactttggcaagcagggatgataccctagacatattaaccagatcattagctaacggtgacagattattgacagtcctcaacaagggcaatactacagttactagagatattccagttcaatggctaggtttaacagaaacagattgcacttacacagctgaggatctctgggacggtaaaacccaaaagatttctgatcatatcaagatagaattggcctctcatgctactgcggtctttagattaagtctaccacaaggctgttcctctgtagtccctactggtttggtgtttaatactgcatctggcaactgtcttacagccgcaagcaactcctcagtcgcctttcaatcatgtaacggtgagacatctcaaatctggcaggttactccaagtggtgttattagaccagtgtctcaaacaacacagtgtttggctgctgatggtaatcttgtaaaacttcaggcatgtgattcaacagattctgacggacaaaaatggacgtacccagttactggtaatttgaaaaacgccaagacagatggttgccttaccgaaggctctgttcaaatgaagtcttgtttgtatgaaagggatgggcaagtgtttgggctaccatcaggggttcaattagctgatgatgatgacaaaggtggttctcctccttctcatcatcaccaccaccactaagg

SEQ ID NO: 455 - DNA, 10289 bp, Artificial Sequence
  pMU3156
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggccaagaagttgttcattaccgctgccttagctgccgcagtgcttgctgcaccattcaaaaacggtgatgttacttctcactaccaaatactaggctctggtttaacaaacaacagatcatcagcctccatcggtaacccagttaatagacactacggtcctctcactaaaaagaaaagattgggcaacagttcaggattaggtaaagtaagacatcacgggaaagttacacctgcttctcctttggatgcggctctaagtttgacaacaatgagaagcctcctgttattagccgccataggctttgctgctgctgaagatggactgtccggatggctccgttatgctagaattaagggtgcaaatggttatcataacaagttaccaagcgctattgtgactcttaacgctactgaaggctctccagtgtacacagcgggtcaagagttgtctgatggtatttcaggaatctttggtaaggacttagactttgccaccacatcttctagaaagccaccaagagatacaactgccacagtaggtactgtctctgcttacattgattctaatccaggtgccgcagacagattgcctgagctggtcgatgatggtttttacctttctgtgtccaaaggtaacgttttgattctaggtcagaatgaaagaggagcactatatggagcatttcattacttatcacttctagcacaaggaaatgcctcagattttactttaacatcaaatccagaagccccaataagatgggtcaatcaatgggataatatgcaagatggcgggactcacgggtcagttgaaagagggtacggcggtgactcaatctttttctgggatgggaagatacgagatgatttgacaagagccggtcaatacgcaagattactagcttctatcggcctcaatgctgtagttgttaataacgtcaatgctgatgccaagactttaacacctgaaaatatggacggcttggggcgtattgcggatgcttttaggccttacggtgtccaattggctgtttctcttaatttcgctgcaccagatacattgggaggcctgggaacattcgacccactagacgaaactgttgcaaactggtggaaagacattacagacgaactctataagagaatacctgatatggccggatacctagtgaaagctaactctgaaggacaaccaggtccaatgacttacaataggacactggctgatggggcgaatatgtttgctcacgctctaaagcctcacggtggtataatcctgtttcgtgccttcgtttacgaccacagaactttgaatcagacattagactggaaagcagacagagccaatgctgcaggggactacttccatgacttggatgacaaatttgaagataatgttgttatccaaatcaaatacgggccaatagactttcaggtaagggaaccagtcagtcctttgtttagccatcttgtaaagactccatctgcaattgagctacaaattagtcaagagtacctgggacaacaagctcatctagtatacttagcaccaatgtggaaggaaatccttgactttgacttcagagtcgatggtaaaccatctagaacatcagacatattgaatggtaaaagattcaatcgtaagctgggtggttatgcaggcgtggtgaatgtggggaccaatactacatggttgggttcccatttggctatgtccaacttatacgcttacggtagacttgcatgggattctagtgcaacctccgagggtatgcttgaagagtggatcaaaatgacctttagcgacgataagaaagtaatcgatgttatcactaaactctccatgcaatcttggccagcatacgaagattacacgggcaacttaggtatacagacattgactgatattctcctagggcattatggcccaaacccagcctctcaagatggtaatccttggggccaatggacgagagccgatggcgattcaattggtatggacagaactgtatggaatggtactggattcgcaggtcaatacccacctcaaatcgcagcgatgtacgaaaaggttgaaaccacccctgacaatttgttattgtggtttcatcatgttccatatacacaagtactgaaatcaggtaagaccgttatccagcatttttacgatgcacattatgagggatcagctgttgctcagaccttccctcaattatgggaaactcttagaggtagaccaggtatcgatgaggaacgtttcgaccatgtcatgtatagacttgtttaccaagcaggacattccttggtttggagagatagtatcaacaccttttatgctaacaaatccggaatagcagatacgaaaggcagagtcggaaaccatccatacaggatcgaagcagaagctatgaaactggtaggttatgaaccttacacagtctcaccatttgaggcagcttctggagctagatgcattgtaacaaaagataatagtactagagcaactgcctcagtcaagttggaagatgtaaaaacaggaaaatatgatgttgctgttaattactacgacatggcgttgggcaattccacttgggaattgtacgtcggctgtgatagaattggaaagtggaaaggcgatcaggagtacatcctcggtcgtgctccttcaccatatattgatggacaaacagcctctagaattacattcaaaggcgtgcatatcaaaaagggcaacacgcttaaaatcgtagggcatccagatggcttagaacctgctccacttgattacgtgtcaatcttaccagaaggaactgttgacgatgatgatgacaaaggtggttctcctccttctcatcatcaccaccaccactaagg

SEQ ID NO: 456 - DNA, 9986 bp, Artificial Sequence
  pMU3157
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgtggagcggcattcctgtattcgcgctcttatcctccatcggcattgcggccgcagaaaatggacttgatggttggctcagatacgcatccgttccttgtaatggaaactgtcaaagagccttgccatcacatatcgtgactctcaattctactaagagtagtcaagtttacgttgccggtcaggagttacaagacggtttgcaccaaatcttaggaaaacacgcctctgtcaaatctacgggctgttctacagattcatcaattgttgtaggaactgtggaggcttatcgtcaagtctgcaacacaggttcacaagctccagagttggatgtagacggattctggctttctataaggggcaagtccgttcaaattgttggtcaaacagagagaggcgcattgtatggggcttacgaatatttgtccatgttagctcagggtaacttttcacaggtcagttatgctacttctccacatgcccctatcagatgggttaatcaatgggataatatggacggttcaatcgaaagaggatacggtgggccatcaatctttttcaaagatggtgtgatccctcaggacctttcaagagtgaagcaatatgcaagattgttggcttcagttagaatcaatggaatcgttgtcaataacgttaatgcaaatgcatcacttttaatgcctagtaacatggatgggctcgctagaattgctgatgttttcaggccatacggtataagagtaggtatatcacttaactttgcatctccatctacattgggaaatttgtctacttacgatccattcgacagttcagtaattgcctggtggggaaacgtgaccgaccaattgtacgctagaatcccagatatggcgggatatctagttaaggctaattctgaaggccaaccaggtccaacaacttacaacagaactctagcagatggtgctaatatgtttgcaagagcattaaaaccacatggcggagtggtgatgtttagagcatttgtttatgatcatcatatatctgaagataattggtacaacgaccgtgctaatgcagctgtcgatttcttcaagccactagacggtaagtttgatgacaatgtagttgttcaaatcaagtacggtccaatcgattttcaagttagagaacctgcttctccactttttgccaatctctacaaaactaatacagcaattgaattacaagttactcaggaatacttgggtcaacagagccacctggtatatttgccaccactttggcaaaccattctgagatttgacttgagagtggatcaaaaaccatcacctgtcagagatatcatttccgggcagagattcgacagacctttaggtggttgggcagcagtagtcaacgtaggaactaatacgacttggcttggatctcatctagctatgtctaacctgtacgcttatgggagacttgcatgggagccaacattagattcagaagatatagttcaagattggattagattgacttttggtttggatagaagagttttagatacgctgacacaaatgtctatggagtcttggccagcttatgaaaattactctgggaatctagggattcaaactttaaccgatattctatacacacattatggacctaaccctgcctctcaagatggtaatggctggggccaatggaccagagccgatcacctgagtattggtatggacagaaccgtcaaaaatggtacaaaattctccggccagtacccagctgaagttgctgccatgtacgaaaacatcgagactactccagataacttaatgttgtggtttcatcatgtgaattacacacaaagactgcattccggcaaaacagttatccaacacttttacgatgcgcattacgacggtgccgaaacggcacaaacattcgtgtccagatgggaaagtctccgtgaacgaattgatgcggaaagatatcaacatgtcttagcgaggttgatataccaagccggtcattctatagtctggagagatgctatcaataacttttaccgaaatctttctggaattgccgatgaaaaggaacgtgtgggctatcatccttggcgagtagaagctgaggatatgcagctggacggttatgtgccttacgctgtctctccattcgaaactgcaagtaactttacagctatcgtcactgcaagcaacggtacaacaggtacagcttctgccacactcgactttaagacaggtacttacgacctagggattaactactacgacatgtacggaggtaagagccattggacagtttacttaaacgatagggtcgtaggccaatggcaaggtaattcagaggacgtgctatcccacactccatcaatatacttggacggacattctgcgacaaggatcaccttcagagatgtaaaaatccataaaggcgatagactaaaaatcgtgggtgaaccagatggcgttgaacctgccccactagattacgctgtagttctccctagaggtatagttgacgatgatgatgacaaaggtggttctcctccttctcatcatcaccaccaccactaagg

SEQ ID NO: 457 - DNA, 9977 bp, Artificial Sequence
  pMU3219
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgatgcgccgtctcttactgcttctgtcggccggcctcgtcgccgctgaaaatggtttagatggctggttacgatacgcccctttacctggcgcttcaagatacctccacgatctgccatcttcaatcgttgctttgaacgcttctgaaacttccccagtcttggtcgccggaactgaattgaggagagggcttcagggtatcttcggtaagcatgtatccatttcacatcaagattgtaatgcatcttcatcaattgttgtaggtactgtagatgagtacagtaagttgtgcggttcaaccgctgcattgcctgaactagatcaagatggatttctattgaacactaaaggcaatacagttcaaatatctgctgttacttctgcagttagatcaatggcaggtgcattcgagtacttgtctatgttggcccaggggaattttagccaagtagcttacgccagtaatcctagagcccctataagatgggtaaaccaatgggacaatctcgatggctcaatcgaaaggggttacggtggtgcttccatctttttcgagaacggaagtgtcgtcagtaatttgactagagctgcccagtacgcaagactgctggcgtcaattggggtgaacgctgtggtagtcaataatgtaaacgcaaacgcttccattttgaccgcagacaacattgacggcttgggcagaatcgccgatgtctttagaccatacggcgtacaattagcgatttctctcaattttgcatcccctactataattggtggcttgaatacatttgacccattagacccatctgtcatcgcttggtggacaaatgtcaccgataacttcaccgcccacccagatatggcagggtatccagttaaagcggattctgagggacagccaggcccacttacttacaatcgaacattggctaaagagcctcctttcttcgcaaaagttttacaaccacatggtggaatggtaatgtttagagcgctagtgtataaccaattaaacgaatcagattggaaagccgacagagccaaagctgctgtggactttttccaaggtctagacggtcaatttgatgataatgtagttgtgcagattaagtacggacctatagactttcaagtcagagaaccaacacctccattatttgctcatctaaggaatacttctacagccatagaactagaagttacgcaagagtacctgggacaacaatgtcatttggtttacttgccacctctattagaagatagaccatctgctctcacatccggtgttaatcaagagtctagaagattggtcagaaatatcattacaggtcaacgttttaacagaactttaggtggggcagcagcagttgtcaacgttggtacaaatacaacctggcttggtagtcaccttgctatgtccaacttgtacgcatacggaagattagcctgggacccagcctcagacgctgaaagagttttgcaagactggatcagacttacattcggtcaggatagaagtgttattgatactattacacaaatgtctatggaatcatggcctgcatacgaaaactattctggtaacttgggaatccaaacccttacagatatcctatacacgcattttggaccaaatccagctagtcaggataataacggctggggccaatggaccagagccgatcataccacaataggaatggatcgtacagtttggaatggcactggctatacagggcaatatccaccagaagtggcagcaatgtacgaaaatatcgatacaacaccagacgatttgctgttatggttccatcatgtgaactatactcatagactacactccggtaagactgtgattcaacatttctatgatgcacactatcgtggagcggaaactgctcaaacctttctgactatgtgggaagcccttaaaggcaaaatcgattccgaaagatataatgacgtgcactttagattgacttaccaagcaggtcactctatcgtatggagggatgcgataacaaacttctactttaatctttcaggtattccagatgaagccgggagagttgaccatcatccttggagagtcgaagctgaatccatgacattatctggttgtaagacttatgcggtttccccatttgaaactgctttcaatacaactgcaatcgttacatctacaaattcaacagtggggaccgcgacaacgaagctagattacagactacatgttaggccaggaagagaactcctgagacatgtaagagggcaagtgcaccttgctggcgtactcaatgacagaaaatcagctaatggctccggaaataaggaagagcatttcggccatacaccttctatctacttagatggacattcagcaacaaggatcacgtttagaggagtgaaaatcggaaaaggtgatgagttaaagattgtcggtactccagatggtgttgagccagccccactagattacgttgctgttttaccaggtggggttgttgacgatgatgatgacaaaggtggttctcctccttctcatcatcaccaccaccactaagg

SEQ ID NO: 458 - DNA, 9986 bp, Artificial Sequence
  pMU3158
taaacaatgtggagcggcattcctatattcgcgctcttatcctccatcggcattgcggccgcagaaacaggtttagacggctggttaagatacgcctctgtcccttgtaacggaaactgccagagagccttaccatctcatatcgtaactctcaattctacaagatcaagcccagtatatgtggctgggcaagagttacaggatggcctgcaccaaatccttggaaaacatgcatcagtgaagtcaacaggctgttccaccgactcttctatcatcgtgggaactgtcgaggcttaccgacaagtttgtaatgcgggacgtcaagtaccacaattcgatgtcgatggattttggctgagtataagagaaaagtcagttttgattgtggggcagtccgagaggggtgcactatatggtgcctatgaatacctgtctatgttggctcaaggtaatttctcacaagtctcctatgcaacaagccctcacgctccaatcagatgggttaatcagtgggataacatggatggttctatcgaaagaggttacggaggcccatcaatctttttcaaagatggcgtaatcagacaagacttatccagagttcaacaatatgcgagattattggcatctgttagaattaacggaataatagtgaataatgttaatgcgaatgctagtttactgatgccttcaaatatggatggattggctaggattgcagatatctttagaccttacggaatccgtgttgggatttcattaaacttcgcatctccaagcaccttgggtaatttgtctacctatgatccattcgacagctcagtcatagcatggtggggtaatgtaacagaccaactatacgccagaatcccagatatggctggatacttagttaaagcaaactctgaaggtcagccaggtccaacaacctacaatagaactttggctgatggtgctaatatgttcgctagggccctgaagccatacggtggtgttgtcatgtttagagctttcgtttacgaccatcacatatctgaggacaattggtacaacgacagagccaatgctgcagtcgactttttcaagcctttggatggtaagtttgatgacaatgtagtcgttcagattaagtatggtcctattgattttcaagtcagagaaccagctagtccattgtttgcaaatttgtataaaaccaatactgctattgaacttcaagttacacaagagtacctaggtcaacagtctcacttagtttatcttccaccactgtggcaaactatattaggattcgatctcagagtagatcaaaaaccatctctcgtgagggatatcatatctggccaaagatttgatagaccactaggcggctgggcagcggtggtgaatgttgggacaaattcaacatggttaggttctcatctagcaatgtctaatctctacgcctatgggagactagcttgggaacctacacttgacagtgaggacattgttcaagattggattagacttacttttgggctagatcgtagaatcgtagacactttgacacaaatgagtatggaatcatggccagcttacgaaaattactctggtaacttaggtattcaaacattgacagacatcctttatacacattacgggcctaatcctgccagtcaagatggtaacggttggggtcaatggacgagagccgatcacttgtccattggcatggatagaaccgtgaaaaacggtactaagttttctggccagtacccagcagaagtagcagccatgtacgaaaacattgaaactactccagataacttgttattgtggtttcatcatgtgaattacacacaaagactacattctggaaagactgttattcaacatttctacgatgcccattacacaggggctgaaacagcacaaacttttgtttcccaatgggagtccttgagagaacgtattgacgctgaaagataccagcatgtgttgacaagactaatataccaagcaggtcattccatcgtttggagagatgctattaacaacttttatcataacctttctggcatcgcagatgaaaaacaaagagtgggtcatcacccttggagagttgaagcagaggacatgcagctcgatggctacgtcccttacgctgttagtccttttgaaacggcctcaaactacacagccatcgttactgcttcaaatggaactaccgggactgcatcagctacattggactttaagactggtacttacgatcttggcattaactactacgacatgtacggcggaaaatctcattggacggtatatttgaacgatcgtgtagttggtcaatggcaaggaaattctgaagatgttttgtcacacacaccatcaatatatctcgacggacattcagcgacgcgaatcacttttagagatgttaaaatccataaaggagatcgtctgaaaatcgtaggtaaaccagatggtgtggagccagctccactagattacgtcgtcgtactgcctccaggtattgtcgacgatgatgatgacaaaggtggttctcctccttctcatcatcaccaccaccactaaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaat

SEQ ID NO: 459 - DNA, 9896 bp, Artificial Sequence
  pMU3159
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctggtccaaaagcaggatgcgacacattgttatctcaaactggccacgagttacaaaagggcatcctaggcatcactggtactcagctgaatttgtcaaccaccccatctgattctgatgccgcaattattgtaggtattgaagatgcgtatttcaatgaatatggaaatcttaatgaaaatgagtatatggagatggatggtttctttcttagcatgtcccctgaaaaggtaataatcgttggtcaaaatgaaagaggtgcgctgtacggggctttcgaatatctctcacagttagcccaaaacaatgtcacttacggatctaaagtctacaaccctcaagtgcctatcagatggaccaatgaatgggacaatatggacggctcaatcgaacatgagttcgctggtccatcaatctttttcagagatggctacgttattgataatactacccgaatagcagagtacgcaagattgcttgcttctgtaggcgttaatggcgtcattatcaacaacgtgaacgccaatgcaacattactttccgatagaaatgtgaagggtttgggcagagttgccgatgctatgcgtccatacggagtccaaatcggcatatctctaaacttcgcttcaccaaaccaaagcctcggtacattcgatcctttggacccaaaggttgatgcctggtgggctaacatcactgaacaaatatactcaaatgttccagacttcgctggttatttggttaaagccaattctgaggggcaaccaggccctttgacttacaataggacactggccgatggtgctaatatgtttgctagagccttagaaccacatgggggtgtggttatgtttcgtgctttcgtttatgataatcatatcaatgaatctaactggcgtgatgacagagcaaatgctcaagtgcaatttttccaggatctagatggtaagttcaatgaaaacgttgtggtccaaattaagtttggtcctatcgactttcaggttcgagaaccagcctcacctctatttggctcattgagatatacatccacggcatttgaagttcaaatatcaccagaatacttgggacaaaactgtcatctgatgtatcttgctccacaatggaaggagattttggaatttgacatgaggtctgacaacagaagttccaaagtaaaagacattattacagggaaaagattcaaaagacctttgggcggttacgctggtgtaagcaatgttggttccgatacaaattggttaggctctcatctagccatgagtaacctatacgccttcggtagattagcctgggatgcatcagtggactcagagacaatccttcaggactggataagactaacatttgggtttgatgaacacgtaatggatacagtcacagatatgtctatgaagtcctggcctgcttatgaaaactattctggcaacttaggaatccaaactcttaccgatatactatacacgcactttggtccaaaccctgcatcacaggacaacaatggttggggccaatggactagagcagatgcctttagtattggaatggatagaacagtcaaaaatggtaccggaaacgctggtctttatccaccagaagttgctaagatatatgacaacatcgaccaaacaccagataatctcttattatggtttcatcacgtcccatacactcaaaagttaaaaagtggcaaaacagtcatccaacatttttacgatgcacattacgagggagcagcaaccgcgcaggagttcgttaagcagtgggaatttctcagaggtaaaatcgatgacgaaagatttgatcatgttctatacaggcaaatataccaagctgggcattctcttgtttggagagatgctatcaacgaattttaccataacttgtctggtattccagacgaaactaaaagggtaggaaatcacccttacagaattgaagccgaatccatgacattgaatggatataaacctgtagctttgaaaccatttgaaacagcgtcagggtacaaagcgatagtcacaattactaataacacaatgggaattgccagtactaaagtggcattcgcatctggtacttacgacattgcagtcaattactttgatttcattggaggaaaggcacgttacagattggaactcggtaacagaacagttggttcatggattggcgatacggaggataagctggggcatacaccaagtatctacttggatggtcattccgctactagaataacgtttcaaggcgtggaagtagaacaaggtgaggaagttagaatcatgggtcaagcagatggaatggaacctgcaccaatcgattacttatcctttttgccaccaggaatcgttgacgatgatgatgacaaaggtggttctcctccttctcatcatcaccaccaccactaagg

SEQ ID NO: 460 - DNA, 10433 bp, Artificial Sequence
  pMU3160
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttcagtcgcgcggcccttgtggcggcggccctggctgctcagcgcgtctatgccctctcagaaggtaattgcgtttcctttgatgcaagctctggtggttttccactggttggggccacaataatcacatccgaagatgattttcctggcgttcatcgtgctgtagcagattttatcgttgacgtagcaaacgttactggtaccgctcctgctgcttttaaccttacggacctcgaaacattgcctagttccgctttaatagtgggaagtgtcaattctactatcatttcacaattatctaactcttacgcagtggatctaagtgctctaacaggccagtgggaaaagtttgcttctggaccagccccagacgcattacctggagttaaaaacgcttacgtgattgcagggtcagataaaagaggtactattttcggcgtttacgaactgtctgagcaaattggcgtgtctccttggtactggtgggcagacgtcccaatctcaaaacatgaggaagtttacctactcccatgcgcacagggtccacctactgtaaaatacaggggcatttttctaaacgatgaggaaccagctttgtccaattgggccaaagcgaaattcactaatggaactctgtcagagttgatgcactcacctttcaatcatcatttttacgaaaagctatttgaattaatccttagactaaaggccaatcacttatggccagccatgtgggggtctgctttttgtgttgatgatgaattgaatcaaccaatggccgactactacggagttgttatgggaacttcacatcaggaaccaatgatgcgttctacaccaaatgaatggaacttattcgggaatggtacttgggattattctaccaatgctgataacatctacccatatttgtacgaaggtgcaaagagagcctcaccatacgaaagtattttctcaatgggtatgagaggtgcaggcgatttgccactttccgacgaaactaatatcgagttactcacacaaattgtagctgacgagagacaaatcctttctgatgtttttaacacaagtgatgtgacaactatcccacaaatctggacattatttcaggaagttcaaggttattacgaacagggtatggaagtaccagaagatattaccctgctgtggagcgatgataattgggggaatgttagacgattccctacccctaatgagagaaatagaaccggaggggctggggtctattatcatgtggactttgttggagatccacgagactacaagtggattgaatctagtcaaattagtaaaatctacgagcaaatgtctttggctgttgaatatgaagcaacaagagtgtggatgttaaacgtgggagatttgaagccttatgagagaagtaccgaatttttcctgacacttgggtggaacgcttccagatggactccagataatgtcggtaccttcgtgacatcatgggcaaaaagagactttcaagttgaagatgcagaggccgaagctatcgcagaaattatcgcgaactttactaagttaaacgctaggagaaagccagaattatggaactccactacttactcacttacaaactatagagaagcacaaaccacattggatgagtggaatgctatcagaaatacgtctacagccatatacgacggcctcccaagcgatgtacaacctgcctacttccaattggtccatcacgcagtccttgccagcgcaaacttgggagaaatgctgattttggcaggtcttaacaatttgtacgcctcacaagctagattaagtactaatgacttagcggataaagtccaagagttgttcgaatatgattatgacctagaagtcgagtaccatagcatattggatggaaagtggaatcacatgatggatcaaacacatgttggttactattactggcaacaaccaatgaccaatacaatgccagcagtaaacagagtacaatctagaaggcaagcgctggcgggtgttatgagaatcatccctgagggcactgctggagcttggccaggagataacccataccaatgtgccaaaggttacgattgtggtgatccaactatctacattgaccgttacagtcctatttctgacagatacgtcgatgtgtctgcaggaggtcctgctccattctcatggaatgttacttctaacgcttcatgggtgtccacctctttacaagggggtgacatcagtcctgattctaaggaagctagactttacttgtctgtcaacgactggtctgctgtcaatggaacctcctatgcacagttgacatttgttgcaatatcctccattgacgatcctctaacagttaatctcacacttgtcgcttacaatccaggcgctccagccgaaggctttactggatacgttgagggtgatggcgtagtttcattcgaagcatcccatgccgctcgtaatacacctgttgacgatctagcatggacagtaattccagattatggtagaacattggcaggcgttactccttggcctagaggtgataaaaactttactgccggcacaggtccaagcctggaatacgatttctacacgttcggtaatgtatcatcagcgaacgtgacagtgtacttgtcaccatcttggaatgctcagggtatgaataattcactatcttacggtctacaagtcgacgaatcagatattgatgtggttgaatatatcccttaccctacaacaataggagggaaaccagctgagtgggcaggtttggacggctttgtagctaacaacatagcaacaggaaaaagcaattttacactttcaggggcaggtgcccataccttgaaattgtggatgacacaaccaactgtagttgttcaaaagatcgttatcgacctgggcggtgcgctggcttcatacttaggtccaccagaatccgtacatgtaggtgcagatgatgatgacaaaggtggttctcctccttctcatcatcaccaccaccactaagg

SEQ ID NO: 461 - DNA, 10661 bp, Artificial Sequence
  pMU3221
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgctcctcacgggtgccaaagggacctcatggctcgccttcgcctccgtggtcgcggcccttggacaggaaccaatcatttcatttgataaagcagcaggggcgttacaaatcgctggtggtaagatatctaaagggcaaattagagtcgctaaaaatgaatattggggagttattagagccgctggagacttagcacttgacttcgggagggttacaggtatgaattacactttatctaatggagaaagaggtgcatccccagccgtatacacttacaacccagtggacaatatgaacaatacacattatagtaccaccggcattgccaattttacaggtccagcttacagtgatccttcaccttcagatactgttatcattgctggtacaattggccatagtgaagttatcgatagcttaattgcctctaaaaagttggacgtttcagcaattaaaggaaagtgggaatcttttacctcccaagttatcaaaaatccaatacaaggttgctcttctgctttggttattgctgggtcagatccaagaggaactattttcggcatatatgatgttagtgagcaaattggcgtatctccttggtacttttgggcggatgtcccaactagacaaaacaaaaacatctacgctttgaataagaagaaagtacaaggtccaccttcagtgaaatacagaggatttttccttaatgatgaacaaccagcattgacaaactgggtagaggaacattggggaaggactccatacggggctggttatgggccagcgttctatgggttgatctttgaagtgttacttagattaagagccaactatctgtggccagctgtttggggcactatgtttgaggttgacgatccaggtaaccaaccattcgccgatgcattcgaaatagtgttgggtacatcacacacagagcctatgatgagggctcaaaatgaatttggccatttctatcaaggtccttgggcttacaatcttaacaatgaaactatcgatgactactttcgttacggagtacagagagcgaagccatacgctagaaatagcctatggactatggggatgaggggtacaggagacacagccatcgagggcctcggagttgaccacatcgtagatatgcttactaccctggttcataatcagagacaaatcttggcggaaggtctgggcgtgtctgatgtcacaacaatacctcaagcatggtgtttgtataaagaggtgatgacctacctctttgctggattagaagtgcctgacgatattactttactctgggcagatgataactgggggcatgttagaagattaccactgttgaatgaaaccgcaagagctggtggtgcaggggtatactaccacttcgattacgttggtgaccctagaaattacaagtggataaacactgtgcaattgtcaaagactactgagcagatgcacatgacctacgcaagaggcgcagatagaatctggattgttaatgtcggtgatatgaaggccaacgagattcctatcaatcattggtttgacctaggatatgatatggaaaggtgggacgttgattcaacagaagagtgggctaagacatgggcagcgagggagtttgggtccacctacgccgacgaaataggtgacatcatgatcaaatacgcaatgtacgcatcccgtagaaagtttgaattggttgaaccacaaacatattctgttatcaactacaatgaagccgatgccgttttgcaacaatgggctgaacttagagcacatgcacaggcagtttacgacaaattggacgaagcctataaaccagctttcttcgaaatgatcctgcatccagctattggcggtgaagttgttcatagaatatatgctggaggtgctaaaaacctactatattctggtcaaaagagaaacagtgctaacgaagtaatcaatcaagtcttagctgcatcagatgaagattggcaactacaggaaagatgggatgcattgctaggagggaagtggagacattttatggatcaaactcaccttggttacgacgggtactggcaacaaccaatgagaaacacactccctgctatggtttatgtccagactcgttttgtctctcttgctggtcatgtgggtgtcggtgttgaaggttcaaatgctacagttccaggtgatgataagtaccatgctaattcaggtaacaatcttagtttacctccaatggacccttacggaccagcaacaagatacttcgacgtattttcaagaggcactaaggattgtacatggcaagcagctccttggcaatcttgggtgaagctaagtcagtacaatggcacagtcggcccaaaaggttctgacacgagagtacaagtcagtatcgattggtcccaagctccaaaagctcctttttcatcaacagtaaacattaacgtcacaaattcctgtggtggcggaccaatggtacaagtgccagttcagattagatccgtgccttctaacttcaccaaagggtttgtggagtctgatggacacgtcgcaatcactggcgcacattactctgctatcataccacctaaagagaaatctaaactcaatgataaagttacttaccatactttgtcaaaatacggaagatcaggtagcggcgttggcttggtaccacttaaaaccgaaaaattgacagttgaaacagctccagctttggaatacgatttgtacttattcactaatcatactaaagcaaacgtgacggtcctaatttctccagcacttaattacttaggtgaatggactcctctagagtacggtatatccctatacccagcaggtgcctctacaccatctgaacctaagatggtcagaccagtgggacctacggttggggcaaatatgccagaaggctggggttacgccgtagctgattccgcgtggggcactgtaggtaattacactacaagcacattctcagtaccacaagagggtgcttacaagttgagattttgggctctaatgccaggcattatggttcagaagataattgtggacatgggtggtgtcagaaagtctttctttggacctcctgaatcttttgttgtcggacgtgaccaagttggtagatacaaccaaacatcctttttagcagaagttgatactttgggtggcctatatgaaaaacaagatgatgatgacaaaggtggttctcctccttctcatcatcaccaccaccactaagg

SEQ ID NO: 462 - DNA, 10430 bp, Artificial Sequence
  pMU3222
taaacaatgttgttgcaagcttttttgtttttgttggctggttttgctgctaaaatttctgcttttgaggaaaagatagtagatttcgaacctagtgccggaagtataccactggttggcgcaacaatcgttgtggatcaatcagactatcctggaatcatcagagctgctaaagacttggcccaagattttggtagagtaaccaaaggtgatccatctccagttgtacttttaaagtctgaggaagattacgtgcagattaatacaaaaactgctatatttgtaggttcaatcggcagttcaccattaatcaaaaagttagtcgaaaatggtaagctcgacattcaatcaatcgatgggaagtgggagtcatttgctgcagggattctcaatgaacaattcggtgcttgtgaaagggcattgatcatagcaggttctgataagagaggtgcaatctttggcatatacactttgagtgaacagattggggtgtccccttggtattggtgggcagacgtacctccaaagtatcatacggggatacacgcaatagagaaacaaacagtgcatggagaaccatcagtcagacatagaggaatctttttgaacgacgaagcaccagccttgaccggttgggtaagagaaacgtttggtggatacaatagtaagttttatgctacagtttttgagcttctactaagattaaaggctaatttcctatggcctgcaatgtggcctggttacccaaacccaggcgcatcatttttcactgatgatccacttaaccaaaagctggctgatgaatacggtattgtcatctccacatcccatcatgaacctatgcaaagactctctaatgaatggttcgcagataaccctgacggctcttggaattggctaactaataagcagaagataactgagtttttcgagcatggagcggggagagcccaaggttgcgattcatacttcactttaggtatccgaggggaatacgataagaaaatgcttgcggaagatccagcctctgtagttcaagatgccattgaaactcaaaggaaggtcatcgaaaaggtgtatggaagtgaaggagctgtacctcaattgtttgctatctacaaggaagttcaatccatgtttgaaaccggcaggctgacaattccagaagatgtcactctgctgtttcaagatgataatttcggcactattcgaagattgcctacaacagaagagtccaagagaaagggtggcgctggggtgtattaccacttacagtacgttggtgatccaagatcctacaaatggattaataccaatagcttgggaaaagtatggcaccaactgcaacaagcgtaccaccataatgccaggcagatttgggtctttaatgtcggtgacttaaaaccacaagagctgccaatctcatttgctatggcgctcgcatgggatataaactctatcaaaaacaacacactacctgaatttttccatagagcagcagaaagagaatttggtactgatctagcagatgaaattggttcaatctggcatcaacatgacagactattatccttgcgaaagcatgaacatatcgaaccagagacattcagtatcttacattacaaagaggctgattccatcctcaacagatggaaagttctcctctcccacgctgaaaggttacattctcaggttaccgaagagcagaaagctgcctccttccaactaatattgcatccaacaaaagcctcttatatctacacagccttgagaatctctcaagctagaaacagactcttcgccagacaacgtagaaactctgcgaacaaaatcgcccaggagatattagacctatttgatgcagatttcgatttgtcagaggaatttcattctcttctgaatggcaaatggaaccacattttgatgcaaccacattacggatacgaagatacatggcacgccccatctagagacatgatttctggtttgtcttatgtccaacgtagacaaaattcaaatccaattgtgggccaaatgggcgttgctgttgaaggacatgagggtgtgagagttggcagaattaatgaggaaagtgaacgtacacacccttccagacgagatttggttccaggtttgactttaggaccaatgtcattatatggcccagacttccgttggtttgacgtttttacaagaggtgttcctacgattaactggtcaacctctgcaccatacccttggattatcttgtctagaaccgaaggggttttagtaccaggtcaagatgacgttagagttcaagtctctataaactggtcacaagtgcctcaagattttcaagaggaagtacttattgatgtgcagtctagagagggagactttgaacaagtacatcttctaattgacgggcgtcatgtccaagactctttcagaggtttcgttgaacaggattgttacatttccatccctgctacagactgtcacatggaaaaaccatacctcatgctgcctgatacaggtagacttgagacaggatctgtcactttggccccaggaactagaactaatagtgaaatcccatacatgaaatacccacttttcactcattcagagactgacaaaactgagcttgtcttatactttgggacaacactagacttatctcctgaagatgttttgacttacgacgtccaaattgatgaaggtccatcacaaacctacaatcttcaaagacgaacaccacagtcagagaaaaatgcagcggacaagggatgggcttctgccgatggctggttctttgcagcatccgataatgtctgggttcgtagacacgaattaggtttgttgaaaacaggtgttcataacttgaaattgagactaaaccatgctaatatcttacttgaaaaagttgtagtggatttcggtggagtgcaagagtcttatctcggccctccagggtctacaaaggccgatgatgatgacaaaggtggttctcctccttctcatcatcaccaccaccactaaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaat

SEQ ID NO: 463 - DNA, 10433 bp, Artificial Sequence
  pMU3161
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgctactgtcagtacttctgactgtcagctgcgtggtaggagctgcacacgctctcggtcaggaaactattgttgctttcgatcaaactaaaggcgcgtacaagttggcaggtaaaaacacggcagcaggcgtcattttgttagatggagatgattggcctggtgttattagagcagctggtgacttggctgttgatttcggaagagttacaggaactaactttacaacaggtttgatcaatggaactactttacatgatcaatcaagcgtgagaggaaatagaggagtcattattgctggcacagtgggtagatccagattaattgattcacttgctgctagaggcaaaatcgatgtatctcaaaccaagggcaaatgggaagcatttcaaacagaagtggtatctaatccattagaaggtatcccaaatgctgttgtaatctccgggagtgacaagaggggagtaatctacggtctttatgacatatctgagcaaattggcgtttctccttggtactggtttgcagatgttgctcctgcacaacataaagaggtttacgctctgaaaaagaagaagatccaaggaccaccatctgtcaaatacagaggtatcttcattaacgatgaacagccagcgttgacgaactggattaacgaaaattacccaccagccagatatggtccaggtttcaacgcagatttttactctcgtgtttttgaacttctgttaagattaagagcgaattacttatggccagctatgtggaataatgcgttttaccctgacgaccctagaaatggtccaacagcagacgaatatggtatagtcatgggaacgtcacacacagaaccaatgatgagagccactaaagagcaatccctatttctagaaggagaatgggattggacctccaatcagaaaaacattacacagtttttcaaggaaggtgcaattaggtcaaaagattgggaagtgctttggaccttgggcatgagaggtaagcacgatacggctaatcctactaatacaaaacaaactctgggagatatcgtcaacacacaacaacaaatactctcagatgtcttaaacatgacaaacatcagttctattccacaaatgtggtgtctctataaggaggttggacaattttacgaggagggtttacgtgcccctgatgatgttactttgttgtgggctgatgacaattgggggaatatacagagactacctctcgggaatgaaaccgctcgttctggtggtgcaggtgtgtactaccattttgattatgttggtgatcctagagattataagtggatcaatactatctcattgcaaaagacatgggaacaaatgcatcttgcttacgaaagacaagcaagacaaatttggatagtcaatatcggggatctaaaaggtgtggagctaccattgaaccatttcctggacctagcttacaatacacctttgtggtcatctccagattctaccctaacatggctaaaccattgggccactagggaatttggaacccaagtatcttctaaagtagccgacatcatggatcgttacgggatgtacgctgccagaaggaagtacgaactcatcgattcatctaccttcagtgtcatcaactataacgaagccgatagagtacaggaagagtggagagcattggttaatgatgctcaaaatgtttaccaagagttgaaagactcagctaggccagcattctttgaattagttttacaaccttgtatggcgggtcaaatagtgaccaacatccatatcacagtggctagaaataacctgtacgctggccaacgtagaacgtcaactaacaccttggctgatcaagctcttaaactgtttaatgacgaccatgccttgacacaaagatatcataagttgttagacggcaaatggaatcatattatggatcaaacgcacctaggatacgattactggcagcagccaatgagaaatacattgccaccactcgcatatactcaagtactggaggaatcattagctggctcaatgggtgtctcagtcgaagcatctaatgcctctgtgccaggtgacgatgtgtggcatagcctttctagtaactctctaactctaccaccaatggacccttacggcccatctacaagatggatggacatatactccagaggtacccatgagttcactttcaccgtaagtccttatgactcttgggtcaaagcaacaccatcctctggcaaaataagtgtgagtgggaataataccgatgcgagaatccatctcagtgttgattgggaaaaggttccaagtggctcacacatggccctgatcaatgtcactatctcttcagatgattacgggaatttcggtatgccaactgtacaacttcctgtaaacaaaactagcgttcctgccgactttcatggcttcgtggaatcagacggtacagtttcaatagaagccgagcacgctactagaaacacatcaagcacagacgtaagttacgcagtaattcctagatacggccatacattgtccggtgttacactgttgccagtcacaattgagacacagcaaccaccttcatcccctcgtttggaatacgacatgtatctgttttcaaatgtgagtacagttaaggccactgtctacctaggcccatcccttaatactgatcactcaagaccactgaaatatgctatttctatcaacgatgccgatcctcaggttgttcagtttgttccatctactccactcggctctttgccatctaactgggaaactactgtgagaaatgccgtttggacaaatacaacatcccatgctatacaaggtggaggcaggaaaaatacccttaagttgtgggcaattgaaccaggagtggtttttcagaaaattgttgttgaccttggcggagttagaccatcctacttagggccaccagagtctatgatcgtagatgatgatgacaaaggtggttctcctccttctcatcatcaccaccaccactaagg

SEQ ID NO: 464 - DNA, 10064 bp, Artificial Sequence
  pMU3162
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggcagctttgccctttgcccttgtatgtcttctagctgttctcgttacaacaagcctggctatacttgaaaagcaaatcgttacattccatccacaggcaggagcagtccctatccataatgctgccatactctacgacactcaagatccagttgctgtcgaaattgctacagaaagtttggctaatgatatcgaaaacattagagaggaggacttagtcgcattgctctatcattactgggctgatgtacctccaacctggcacagcactatctacgcacttcctaaaactacaaagcaaggaccaccaagtgtgaaatatagaggtctgttcattaacgacgaagcgccagcattaacatcctggtggtctaaaaagcactcagtggatcattatcctctagacgccgaattttacagacatgtttttgatttgatattaaggttaaaaggcaatttcatctggcctgctatgtgggcatctcatcatgagccaatgcagagggcaaccaatgaatggaacagttcagaaactggtgagtgggattggacagttaataaggctaaagtaactagattcatgagagaaggcgtgagaagagccgctaaaaatgaaacctattttacattgggtatgagaggagcttctgattctgccatatctgcaccagaccctatcgcattattagaagaggtgtttgaaacacaaagagatatgttgaccgaagagtacgggaacctgtctgatgttaagcaagtatggactacttataaggaagtggcaacatattacgctggaggtctgaacccaccagaagatgtcactttggtctttacagatgataactggggtaacatcatgagattgccaaacgcagaggaagctgcaagaccaggcggtattggattgtattaccactttgaatatgtcggtagaccaaaatcttacaaatggcaaaatacgaacaatctcgccaaagtttacaaggagctttctcaagccttagaaagaggagccgatagaatctgggtgtttaacgttgccgatattaagccaatggagttaccattcgctttcgcaatggacttggtatggagttcatcacgtttcgacttcagcaccattcctagatacctgaaggcctttgtcttgagagaactagggtgtaaagacaatgaggctgaagagattgcgtcaattctgttacaacactctgaactggtaggcagacgaaaatacgagggcgtaacttctgcgacttactcattctacaattaccatgaagttgaaagagttctacaagagtgggaagatttgggtgacagagtaactaaagcgctggcctttatgttttccgcttctcaggctgcttttactcatttggtacaatacccagttcaagcaggtctgatataccatagaatagttttgggtcaaacgattaatcagcaatttgcgatccaacgtcgaactcaacaaatccaattgcagagtaagtcatcacaacgtctgaaacagacacagatttccgaaaagtcctttatgccatgcctagcagcaaatggaatgggcctttggacaaatcaatcttggtcaaacggtaacggtagaagagggtgtacattgcttggcacccttttcagaacatgtcacttgtgctcacgtgatagaacatcttttatcacatgggttacatgggaatacaccctcagagatcgagaagtccctttatgctcacctccaattctcccaactatggacccttacgggccagcattctacactgttgacttgttccatagaggtaatcatagaaagccaatctcattcaacctttcaataccttacgaatggatcaatatctctctagtatctggcaagctgtcccaagagaatccagaggaaagattaacagtatccatcgattggcctaaagttcctgaatcctttaacgaaactgtcctaattgacatccattatgacactcaaccacatttcgagaatctacacattccaattttgaatagaccagccttgcctgctggctttcacggatttcctgccacaaacggatacgtttctattgaagctgcccattcccaaagagccatatcaggtagcgataccgtgtctttcaaggctctaccacatttggggactcgtactaaaagtggtgctgttgctcttaggccatacgaagctgctagagtctctaccagtaccgctcagaatacacgtgtggaatacgatgtgtttttgctgggttcaagtaaaaatctaacagccacactatttttgacacaaaatagtgatacagatccatctttaccaatgcaatattccctcgcaatcgatagctctgaagcctcttttactagattattacaagagccagagacaccaggtgacttgcctgacatttggactgatcaggttgaagatgaagtctggacagtccaagtccaattagggccagtatctgcaggtaagcatactctagcttggagagttaattctccagaagtttaccttgaaaaagtggttctagataccgcaggcgctgttagaaaatcatacttgggccctcctgaaagagatgatgatgacaaaggtggttctcctccttctcatcatcaccaccaccactaagg

SEQ ID NO: 465 - DNA, 10061 bp, Artificial Sequence
  pMU3163
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctacttttcaacaaccatccattgtggaatcaacattcaaagattggaagtacagagaatataagacatctgaatggaaattgtctagaactgatgcagaaaccaccgaaattcatgcagacctattagcaaataaggaaatcccagacccttttatggatacgaacgagagagatgtgcagtggatcggagagaaagattgggagtatggcaatgaatttttcgtttctgcaaacgctaagcctttatcagtacatgaattagtctttgaaggcctagatacttttgcaactgtttatctaaacaacgaggaaatcttgacaactgataacatgtttcgtgaatatagagtcgacgttacaaaatatctaaacttcgatggtgctaataacttgagaatcctattcaaaagtgctcttcatacggctagggctctagaaaggaaacatgggaagttgttttgcttcaatggcgaaagttcccgtgttcaagtccgtaaagctcaataccacttcgggtgggattggggtccagttctcataacatgcggtccatacaagcctgtcaaacttgtctcttacgattcatacattaaagacgtatacttcaaagtcgatgttaataaggaattaaaggcatcaatcgatatccagtctgatatctttactggttctagtagtagtaccctggaaattgaagtgaagtctccatctgggtccgttatacaaacattctcctctaaggttgataagtcagacattttctcacataagtttgccgtcgaggaaccagacttgtggtatcctttgggtcatggtaaacaatccttatatgagtttaagatcagtttagaaaatcaggttatcgtcaaaaaggtgggcctgagaaaagtcgaattagtacaagagtcctttgccgaacaagagggatcttccttctactttaaggtgaataacatccctatctactgcgcaggctcaaattggattccagcacactccatgcaaactcttttagtggattcagactacaagcagttattacaactaatgatcgacggacatcaaaatatggtcagaatctggggtggaggttactacgaacaggatatcttctacgatgaatgtgacagaatgggtatattagtttggcaagattttatgtttgcttgcggtcaataccctggttaccctgaatatttggaatctgttagcgaagaggcaaagcaccaattaaagagactgaggaatcattgttctctcgcgatatacgcaggtaataatgaagattaccaagtggcagagcagtttaatcttgagtgggacccaacagacaatagtggtgattactccaagtcaaactttccagccagaacactttacgaaacaattttccctaagctggtttctgaattttgtccagaaattccatatcatccaggctcaccttggggaggcaacggcactgcagatccaacagttggggacttgcaccaatggaacgtgtggcatggttcccaagagaaataccaagagtggcacaagttgggagggagattcatatctgagttcggaatggaggcattaccaaatagaaagactttcgaggcctgtattacagacccagacgaactgtacccacaatcagaaagtgtagatcaccataacaaagctgacggatttgaaagacgtttggctctttacgtcattgagaatatcaaagtgcaaggtttagacttcgacagctggatatacgccactcaacttatgcaagctgaatgtctaggatacgcttacagatattggagaagagaatggagaggtgacggtaagagatacacaggaggcgcaattgtttggcaaatcaatgattgttggccagtgacatcatgggctattgttgatttttacaaaagaccaaaattggcctactactcagttaaaagagaatcaagaccaatcggcttgggcatgtttaggaatgagaaaaagcatactcatgaacaggcaaaaccacattctacagctggacctcctcatgattactctcaagtagattacaatgttgatatttggggagtaaactccaataccgtagatcaacctgcggtattaaaggtggatatctacaatgtaacttcaggcaaaaagctggaatctcttccagatcaagatgttgttctaaaatctaactcttcaacagaatttgtttctgcccatccaattgccaatgaccaaccaatcgttgtctatagtagattcgtgagcaaagaggatggttcaataatagcctcagccggtgattggccacaacctctcaaatacttgaaatttcctggccgagaagttaagtttgaagtctctaatggttctatcaaattatcctcaaacaaacctgtaaaaggtgttgaaatcctagttgaaagagatgtatttctccaagataacggcttcgacctgtttccaggggatgaaaaagtagttatagcggaagatttgaaaaccacagacaaagttactgtaagatattatcaacaacaggatgatgatgacaaaggtggttctcctccttctcatcatcaccaccaccactaagg

SEQ ID NO: 466 - DNA, 10262 bp, Artificial Sequence
  pMU3223
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcgcatcagggaacagacaatcctagcgttgctttccccagggctgcctccagtgaccggtcaacatgtcctcgatttgtctgagccaggatggactgtttcctcaaaagccctgaacagaacagtacctggtcgattgccatctcaagtacatttggatctttttgaggctggagttattgctacaatgggctctatgattttgactttcgctggactgagaatgccaaccggtagaacaccagccacgctactactaggctgtgaattgacagatcatgaaagtacatggttagtgtttgatggtttagacacattcactactattactttttgcgaccaaatcatcggttcaacttataaccaattcagacagtaccatttcgatgtttcccaggtcttgaaggaatgtaaacaggaaggcccagtactttcaatcaacttcggttctgcacctaacatagcgaatgctatcgcaaatggtccttctgctgaagagtggcctgccggagtccaaattacaaatgagtatccaaacagatggtacattagaaaggaacaatctgactttggctgggattggggaccagcatttgcaccagctggcccttggaaacctgcatatatcgttcaaaacaaaaacccagatcgattatacgtcctgaatactgaccttgatatctacagaagaggccaaattaaccatctacctccagatcaatcacaatcctgggttgtcaatgcctctattgacgtcctgggtagcgtgcctcaatggccttcaatgtcagttgaaatcaaagatgcttacagcggggtggttttatcttctggattgttagaaaacgtaacagtctcaggtaactctgtaactggtgtcactgtggttgatggtagaactcctaagttatggtggcctaacggtatgggtgatcaatccctgtacaatgtgacaattgcagtacacaatcaccgtaaccaagtcgtagcagaagtcatgaagagaacaggttttagaacaatctttctaaaccagagaaacattactgaggaacaattagctcagggggtagctccaggtgctaattggcattttgaaattaacgggagagagttttatgcgaaaggctcaaacataataccaccagacgcattttggccaagagtgactccatcccgtatggaaaggttgtttgatgctgttactgccggaaatcaaaatatgttgagagtgtgggcttcaggtgcatacttgcatgatttcatatacgatctggcggacgaaaaaggaatcttattgtggtctgagttccaattttccgacgcactttatcctgttgatgacgcttttctcgaaaatgtcgcggctgaagtggtttacaatgtcagaagagttaatcaccatccatctttggccttatgggcaggcggcaacgaaattgaatctctaatgctcccaatggttagaagagctgatcataaaggctatgcaaagtacgttggtgaatacgaaaaactctacatctcattgattttgccattggtgtacgaaaatacaaggtctatcacttattctccaagttcaactaccgaaggatacctacatgtgaatctttccgctccagtccctatgaccgaaaggtattccaatactaccccaggttcatactatggagatacggactattacaattacgatacaagcgtcagcttcaattaccataagtacccagttggcagattcgcaaatgagttcggtttccactcaatgccttccttacaaacttggcaacaagctgttgacccaaaggacctatactttaattctagtgtagtagttttaaggaatcatcattacacagcaggaggattgtttactgataattaccagaactctagtagagggatgggtgagatgacaatgggagttgaatcatactatcctattccatctaaaagtgatccagtggctaacttttccgcttggtgtcacgcaacgcaattgttccaagctgacatgtacaaagcacaaatacaattttacagacgaggatcagggatgccagaaagacaactcggatctttgtactggcaattagaagatacatggcaggccccaacatgggcaggtatagaatacgatggtagatggaaaatgctgcactacgttgcgagagatatctacgaacctattatcgtgtcaccattttggaactacaccacgggcgatcttgaagtttatgttacttctgatctttgggagccagctcaaggcaccgtgaatctaacatgggtggatttgagtggtaagtctatcgccggtaacgccggaacacctgaaagtatacctttttcagtaggtgctctcaatgccacagacgtttatagtgcgaatgtagctgatttgtcaccacctgaccttactgattctattttgatacttagcttagccggtgaaggttatcttccaaatgctagaacaagatcagagtttagacatgagaatcaattcacgcctgtttttccaaaggatctcgcactccgtgacccaaaattagagctggcttacaatcctgacacacgtacctttacagttgaggccactgcaggagttagtttgtacacttggttagattatcctgccggtgtagtcggctacttcgaacaaaatggctttgtattgttaccaggaatgaagaaagaaatcggtttcgttgttcaggaaggttctgtcgatgaggattggatgagaagcgtaaccgtcacatctttgtgggatcaaaaggttagagaagatgatgatgacaaaggtggttctcctccttctcatcatcaccaccaccactaagg

SEQ ID NO: 467 - DNA, 10049 bp, Artificial Sequence
  pMU3164
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctacaatgacatcacaaactacttacaataccttatctaattggtcttacaagagagcaaataaggactcaacaaagtggcaaccatgtagcaaaaagactaatgggaaccaaattcacacagacttattgaataatggtgaaataccagaccctttcatagacaggaatgagaaagacctccaatggataggtgaagaggactgggagtataagacgacattcaaggtggatagcaacaaaaagcacgaattggtttttgaggggttggacacttttgcaactatctacgttaatgacaagcaggtactgacaacagataacatgtttcgtacttatacactagatgttactaattgctcccaggaatctaacgaattgagaatcgtttttaagtctgctttgaaagtatcaagagccttagaggagaaacatggtaagtttacctgtttcaatggcgaaacaagtagagtacatgctagaaaggctcaataccattacggctgggattggggaccactcttactgacgtgtggcccttggaaaccaatcaaactggttacttattccactgcgaagattaatgatttctatgttaaacaatctgttgacgaaaacctacaggcagaactatcattcgaagttgaagttgaatcaatttcagatgactgccaacttagcatcgaaattttctcttctgccggcaaattgatccgtacaattaaggagagcgcaaacaaatcctacaccttcgatccaattaagttagaagatccagaattgtggtacccaaaagggtatggaaagcaacctttatacaagtttgttgccaaactccatcaaacggaccaaattatcgactctgtagtttctgaagtcggagtgagaagagctagactggttcaagagccagttaaaggccaagatggttcatctttttactttgaggtcaacaacatcccaatcttttgtaatggttcaaattggattccaagccactccttttcctgcagtcttatcgatgatgattacgtcgacttgataagattggtggatgaaggtaaccaaaatatgataagagtatggggtggagggttttatgaaaatgacatcttatacaaacagtgcgataaacttggtatactaatctggcaggatttcatgtttggttgtgcaatatatcctggatacaaagagtttatagacaatgtcactcatgaagtgatcgaccaactaaagagactacgaaattactgttccatcgttttctacgtgggcaataacgaagattatcaggtcgctgaagatttgtacaagaagaacactttcacggatgaggaatttcctgccaaaaagctgtacgagagaatcttaccagatatggtatccaaattaacatcaggggtaggctaccaattcggttcaccaatctccccaggacaaggggtaccaactacagatgttaccgtaggagatatccatcaatggaacgtttggcatgggacacaggaaaaataccaagattggggaaaactcgttggtagattcgtttcagagttcgggatgttagcctttcctgacattaaaacccttaaggattgcattacagatgaaaaacaactttatccacaaagtgaaactatggatcatcataataagtctattggttttgagagaagattagcgctgtacgttatggagaatttctcagtctcttcaatggctctagcagattggatatacatcacacaactcatgcaatctgactgtctagcatacgcttacagaaactggaagagagaatggggttccaaaaatgagagaaaatgcggtggcgctctagtatggcaaattaacgactgttggccagtcacctcttgggccatcattgatttttaccatagaccaaaattagcctactacgcaattaaacgtgaatgtcaaccactaatgttaggcatctacaggacagaaactagattaagacagcctggtgaaccagacttggaaaaacaagcaccattacatgattacagtcctcgtgaatacacgattgacgtttggggtgtcaattctactttgcaagatttttctggtacattagaagtggagttgtatcattgtgaaaccggtgaactcgtgtctaatcttgagaaaagcaaaataacattggctcctaaccagactacagaattggtcacaaagtccaagatcgactccaataagctagtggtccatgcaaaattagttgattctgcgtcaaagctcgtttctaatacgagtgattggccacagccactaaagtacattatctggccaaaggatacaaaactggatgtttcaatccctgaaaacggaactattaagttgtcaacaaacaaacctgtgaaaggtatcgccctcaatatcgaaggagattattacctgcatgataattcaattgaccttctccctaataatgatcactatatcaaagtggataacctgcaaagtgacgatgtcgcaaagatatctgtcaactaccttaaagatgatgatgacaaaggtggttctcctccttctcatcatcaccaccaccactaagg

SEQ ID NO: 468 - DNA, 10049 bp, Artificial Sequence
  pMU3165
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctggcgctttcactcaacatgttctgtctgaaggctggtcttttaaagactctggcgatcaatctccagatgcatggttgtctgttcctacagtaccatcagttgtacaccaggaccttcaagctaatggcaaattggacgacccattcataggcctcaatgaattgagtgccagatgggttaatgaaaaatcttggacttacagaaatgtgttccaaaagccaactgttccagcaggtagttcaatatttctagtttttgatggtttagacacttttgccaaggtaaaactggacggccaagttattttggaatccgataatatgtttttagctcacagagtagatattacaaaggcactggacgttgaaggggagcataccttggagatcgactttgactgtgcacttctaagagctagagaactcagaaaacaacatccagatcataagtgggtgggcttcaacggtgacacagccagattaagcgttagaaaggcccagtaccattggggctgggattggggtccagttctaatgactgctggcatctggaaggaggttagattagaggtctattccgcaaaaatctctgacttgtggactgaggttcatctcgcggaggatcattctaaggcaaggattacagccgctgccgaggtcgagacacaaggtacaggtaactcctataaagctacttttacgctgtccctacagggacaacaaatcggtaaagaggtggctactttggatgggaatgtagcgaaaaccacatttgatgtgcaggagccttcattatggtggccaaacgggtatggtgatcaaactttatacgaaatatcagtctccctcgaaaaggaagaggaacaagcacaccaagtctctaaaaagtttggtatcagaacagctgaagtcatacaaaggcctgataaacatggaaaatcatttttctttagaatcaatggggtcgacatcttttgtggaggcgcttgttggattcctgcggattccttattgacaaatatcaccccagacagatacagaaaatggatcgaacttatggctgtaggtcatcaggttatgattagggtatggggaggtggtatctacgaggatgaatcattttatcaagcgtgcgatgaagtaggagtcatggtgtggcaagatttcatgtttggttgtggtaattatccaacttggccagaaatcctggaaagtatagagaaggaagctgaatacaacttgcgtagacttagacatcatcctagtattgtgatatgggtcggtaataacgaagattaccaagttcaggaacaacaaggattgacgtacaactatgctgataaagatccagaaagttggctaaaaaccgatttcccagcaagatacatctacgagcatttgttgccaaaagcagttcaaaagattatcccaagtgcttactaccatccagggagtccttggggagatggtaagatcacatcagatcctactgttggagatatgcatcagtggaacgtatggcacggaacacaagagaaataccagattttcgataccttaggtggtagattcaattcagaatttgggatggaagccttccctcacatgtcaactatcgaccattttgtaacaaacgaagcggataagtatccacaatctcacgttttagacttccataacaaagccgatggtcatgaaagacgtattgcaacttacttagttgagaaccttcgaactgcaaccgatctagaaacctacatttatctaactcaagttgtgcaagcggaaacaatgatgtttggatacagagggtggaggagacaatggggcgacgaaagacattgcggtggcgcattactatggcaactcaatgattgctggccaactatatcttgggctattgttgattacttccttagacctaaacctgccttctacgcagtctcacgagtactaaagcctcttgctattggtgttagaagagaacaccacgactggtccgtttcacacgctcaaccaccaaaaacatctaagtatgaactgtgggtagtgtcatcattattgaaggaagttattggcaaggttgagttaagattcatatccataaaaacaggcttagctatccatgaatcaatcgtcagagaaaacgtaactatcgtaccaaatggtacaacaaatatcctcgacggtgtcatcgatcatgccgtcgatgaaccacatgttctcgccgcaagactgtgggtggatggagaactcgtggccagagatgtggattggcctcaaccattcaagtacttagacctgtctgatagaggacttgaaattacacgtattagtaagacagaatctgaacaagtcttagaattgtctgcacgtaaacctgtgaagtgtttggtatttgaagagagagataatgtaagagttagcgactcagcaattgacattgtaccaggagatgaacaattcgttacaatcaaaggtcttaaacgtagcgatgcaccactaaaatacaaatttctaggacaggatgatgatgacaaaggtggttctcctccttctcatcatcaccaccaccactaagg

SEQ ID NO: 469 - DNA, 10040 bp, Artificial Sequence
  pMU3224
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctgcaaaatctcaatcattatcttgctacagacttagtgaaggatggtctttcaaacaaagtgacgacgccactaaaaacgcgtggatgccagttaaaaaggtcccaacaaatgtacaccttgatcttatagaagccggaaaaattccagatccattcctaggttttaatgaactacacgcagagtgggttgctgataaggcttggacttacaaggttgaattgccacaagtacaagaggcaaatgaaggaacaacacatgtcctggcttttgacggtttggatacatttgcaacagtccgtatcaacggcgaaactgttttggaatccgataacatgttcatcccacatagactagatgttactaaaaagctaagattaggcgagaaaaacatccttgagataggctttgcttcagctagattagaagcaattaagattaaggaaatgtaccctgaacacaaatgggttggctttaatggtgatatgtcccgtcttgctgttagaaaggcacaatatcactggggatgggattggggtccaatattgaatacttgtggtccttggagagaagtaagactagaaacatatcaagccagatttgaggacttaagagttgattacaagctggaatcaggattgaaatctgtgcatggtacagtgtctgctacagttcaaggagttagtgctgacagtgtttcattcgatgtgtttgatggggataaacaagtgtttaaggaaacagccaaaatttctaacggcgtagcaacagtagattttcatgttaataaccctaaactgtggtacccacatggttacggcgaacaaccactgtatactgtaacagccaccttattcgcaaatgatgttaaacttcatcaaacatcacgtagaaccggttttagaaaaggcgaacttatacaagagccagatgccattggaaagtctttttactttagagtaaacggggtcgatgttttctgtggtggttcagactggataccagcggactccttcaccccaagggtgaccgaagatcaatacagaagatggttggagttaatggttgatggttaccaaatcatgatcagaatttggggtggtggcatttgggaggaagatgtgttttacgatatctgtgacgaattaggagtattagtatggcaagacttcatgttcggttgtggaaactacccagctttccctgacatcttgagatcaattaaggaagagtgtactgctaacgtaacaagacttagacatcatccttcaatcatcatctacgccggtaataatgaagattaccaagttcaagagacttatgggctaacttacgattacgatgataaagaccctgaatcttggttgaaaacagattttcctgctagatatatctacgaaaagctgctcccagatgtggttgcggcagaatctccacatgttccatatcatcctggttcaccttggggagatggcttaaaaaccagcaatccaacggtcggagatatgcatcagtggaacgtttggcacggcacccaggaaaagtaccaaatctttgacactctaggtggtcgtttcaattccgaatttggtatggaagccttcccacatatcgatactgtcagatactggtgtacagatcctacacaattataccctcagtcacacatgatagactttcataacaaagctgatggacatgaacgtagaattgcaacgtatctcgttgagaattttagaactaaaactgatctagaatctttcatacatttgacacagttatctcaagcagaagcacttatgtttgggtacagaggttggagaaggcaatggggacagaatagacactgcggtggtgctctcgtttggcaattgaatgattgctggccagtgacttcatggtctattgttgattatttccagagaaagaaaccagcctactatgcaatgagaagagttctggctcctattgcagttgccgtgaagcgagcacatttcgactggagcgtagtccacgctagagtaccagccacaagtgactacgaagtatgggtcgctaatcagaagctagacgaagtggtcgccacagttgaattaagatacatctccgtgaaaagcggcaaagagatcaaggagaaaattgtcaaaaaggacattagactggtcccaaatggtacaactgacgtgctatcaggaaccattgacaaccgtaatgagcaacctcatgtgttggcagttcgtatatgggtcgatggtgaaatcgtatctagagatgttgactggccacaacctctcaaatacttagatttcgatgatagaggcgtagaagttattccaagaggggaaactattgtcgttagagcgcaaaaaccaactaaaggtttggtatttgaagagagatccggcgttttagtccatgattccgccatcgacctagtaccaggggatgagcagatcatcaaggtgagaggcttgggccctcaagataagccactgcgttggacctatttggggaaagacgatgatgatgacaaaggtggttctcctccttctcatcatcaccaccaccactaagg

SEQ ID NO: 470 - DNA, 8930 bp, Artificial Sequence
  pMU3166
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggcaaaagctctaaagtacttcgcatggggactcgctgcactggcttctggagctgttgctgctccatactgtgcaccacaacctagtacaacatctcaagagcctacatccactccatcacctgtaccaggaccacgaacatttgaagcagaagatgccatcttaacggggaccagagtagaaagtagcttggcaggttactcaggtacaggctacgtcgcaggttttgatgaaccatctgacaaaattactttccatgtagattcagaaactacaaggctttatgacttgacaattagagtcgcagcgatatacggtgaaaagcgtactactgttgtgctgaataacggagctgcttctgaagtttacttcccagctggcgattcctttgtcgacatcgcagctgggcaagtgttgttaaaccagggtgataacacgattgatattgtgaataattggggttggtacttaattgactcaattaccatcacaccttcagccccaagacctccacatcagatcaacccatctccagtgaatccagcagccgatgataatgccagagcactctacgcttatctaaggtcaatatacggtaaaaagatactttctggccagcaggaattatcctgggccaattggattgctcaacaaacaggtaagactccagcccttgtctctgttgatatgatggactactctccaagtagagttgaaagaggcacggtcggctccgccgttgaggaagctatagaacaccatagaagaggcggcattgtttcagttctgtggcattggaatgccccaacaggtctgtacgacactcctgagagaagatggtggtccggattttacaccgacgcaactgattttgatgttgctagagcgttagcagacactaccaacgccaattatacattactaataagagatatcgatgctatagctgtacaattgaaaagactgagagatgcgggtgtgcctgtactatggcgtccattacatgaggcagaaggcggctggttctggtggggtgccaaaggaccagaggcgtacaagaaactctggggaatcctttatgacagattgactaactatcatggattgaacaacttgctatgggtttggaacagcattttgccagaatggtacccaggtgatgaaacagtagatatcgtatcagcagacgtttatgcccaaggaaatggtcctatgtcaactcaatacaatcaactaattgaacttgggaaagataaaaagatgatcgctgctacagaagtgggtgctgcgcctttgcctgatttgttgcaagcctatgaggcccattggttgtggtttgctgtttggggtgacaccttcatcaataatccacaatggaacagtatcgagacacttaagacaatctacaattctgattacgtcttaactttagatgaaatccaagggtggagaaatgcacaagatgatgatgacaaaggtggttctcctccttctcatcatcaccaccaccactaagg

SEQ ID NO: 471 - DNA, 8894 bp, Artificial Sequence
  pMU3167
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggccagggctctcaaatacttgctctacggagttgctgcctttgccgcgggcacgagtgcggctccagtttgttctgcaccaggtgggggtggggcctcaccacgagtctttgaagctgaggacgccactttgggcggaaccactgttgatacagcacaagccgggttcactggaactggttatgttaccggttttgaagatgcgacagacaaggtaaccttcacaattgactctgagacaactcaactatatgatctttcaatcagagcagcagctatctacggagaaaagagaacgactgtgatactgaacggcggtgcatcctccgaggtgctgtttccagcagcagatacgtgggccgatatagctggtggccaacttttgctcaatgctggtgataatactgttgaaattgtctctaattggggttggtacttaattgactcaattaccttgactccatccgcaccaagacctgcgcatgatatcaacccttcaccagttaatcctagcgctaatgcagatgcaatcgctttgtactcttacttaagatccatctacggtaaacaaattctatcaggacaacaggaattatcatacgctgattggatagccgaacagacagggaaaacacctgctcttgttagtgtcgatctaatggactactctccatctagagtcgagagaggcactgtggggacagcagtagaggaagctattacccatcatgaaagaggtggtatcgtatctgttttgtggcattggaatgcccctactggtttgtacgatactgaggagcaaagatggtggtctggattttacacagcggcaacagactttgatgttgaagccgctttagcatctacaacaaacgcaaactacacattgctgattagggacatagacgcaattgccgttgaattaaagcgtttacaagcagctgaagtcccagtattgtttagaccactacatgaagccgagggaggttggttctggtggggtgctaaaggcccagaaccagctaaaaagctgtgggggatactttatgaacgtttgactgttcatcacgaaatcaacaatttgatttgggtgtggaatagtttagctgaatcctggtatcctggcgacgacacagtagatatcttaagtgctgatgtctatgctcaaggaaatggaccaatgtctacacaatataaccagcttatcgaattgggtaaggataaaaagatgatcgcagcctccgaagttggcgctgctccactacctgatcaactacaagcctacgaagcacattggagctggttcgctgtgtggggtgacacattcatcaataaccctgattggaactcaccagaaaatcttaaaactgtaggatacttaccagctcaatcaattatcagagtaggctcactggatgcgaatagagatgatgatgacaaaggtggttctcctccttctcatcatcaccaccaccactaagg

SEQ ID NO: 472 - DNA, 8471 bp, Artificial Sequence
  pMU3129
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttcgccaaattgtccctcctttctcttcttttcagctctgctgcgctgggcgcttcaaaccaaacattatcttatggtaatatcgataaaagtgccactccagaagctagagctttgctaaagtacattcaactgcagtatggttctcattacatttccggccaacaagacattgattcatggaactgggtggagaaaaacattggggttgccccagctatcttgggttccgattttacttactattcaccttctgccgtagctcatggcggcaaatcacatgcagtcgaagatgtcatacaacatgcaggcagaaatggtatcaatgcattagtttggcactggtacgccccaacatgcttactagacaccgctaaggagccttggtacaaaggtttttacacagaagcaacatgttttaacgttagtgaagctgtcaatgatcatggaaacgggacaaattacaaattgttgttgagagatatcgatgcaattgctgcacaaatcaaaagattagatcaagcgaaagttccaatcctatttcgaccactacatgaaccagaaggaggttggttttggtggggtgcacaaggtccagctccattcaaaaagttatgggatatcctctacgatagaattacgcgttaccataacttacacaatatggtttgggtgtgtaataccgctgacccagcatggtaccctggaaatgataagtgtgatattgctactatcgaccattaccctgccgtcggggatcatggagtagccgcagatcaatataagaaattgcagactgttacaaacaatgaaagggtactggcaatggcagaagtgggcccaataccagacccagataagcaagcgagagaaaatgtgaactgggcttactggatggtttggtcaggtgactttatagaggacggaaagcagaatcctaatcaattccttcataaggtctataacgacactagagtagttgccttgaattgggagggagctgatgatgatgacaaaggtggttctcctccttctcatcatcaccaccaccactaagg

SEQ ID NO: 473 - DNA, 8849 bp, Artificial Sequence
  pMU3168
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgacacgagcgctcaagagtattttgttaggcatagcggctctggcagtaggaacacatgcagtaccttgtcaaggccctagaacttatcaagccgaggatgccgtgcttactggtacgcatatcgataccgctcaaccaggatacactggatctggatacgtcacaggttttgaccaatcatctgataagatcacattcaagatcaatagtccaagcactagattgtacgacctgagcataagagttgctgcaatatacggtgaaaagagaactaccgttgtattaaacggtgcatcctcttcagaagtttactttccagcctctgattcctttatcactgtatcaggtggccaagttttgcttaatgagggcgctaacacactagacatcgtttccaattggggttggtacctgattgattcaattactcttacaccatccgctccaagagctgctcataatatcaacccaaaccctgtgaatccagcagccaacgctgacgccaaagccctatacaattacctcaaatcaatatatggaaagaaaattctatcagggcaacaggaactatcttgggcaaattggatttctcaacaaaccggtaaaacccctgcattagtttctgtagacctcatggattatagtccatctcgtgtcgaaagaggaactgttgggacagcagtcgaggaagcaattcaacatcatgaaagaggcggtattgtgtctgttttgtggcattggaatgccccaactggcttgtacgatactgaggaaaataggtggtggtcagggttttatactagagctacagattttgatgtcgaacaggcattgtcctccaccacaaatgcgaattacacactgattatcagagacatcgatgctatcgctgttcaactcaaaagattacaagatgctggtgtcccagtcttattcaggccacttcacgaagccgaaggcggttggttctggtggggtgccaaagggcctgaaccatgcaaaaagttgtggaatctcctttacgaccgtctgacgaattatcatcaattgaacaacctgttgtgggtatggaacagtatattgccagagtggtacccaggggacgacacagttgatattttgagtgccgacgtgtatgcgcaaggtaacggtttagttgaacttggacaggataagaaaatgatagcagctacagaagtaggcgcagcccctctacctgatttgttacaggcttaccaggttcattggttatggtttgctgtctggtcagatggattcatcaataacgcagagtggaactcattagaaacgttgcaaacaatctacaatcacgattacgtgctaacacttgatgaaattcaaggttggagaaattctgctgatgatgatgacaaaggtggttctcctccttctcatcatcaccaccaccactaagg

SEQ ID NO: 474 - DNA, 8873 bp, Artificial Sequence
  pMU3169
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatggtcaagctcctcgacatcgggctcttcgccctggccctggccagcagcgctgttgcgaagccttgtaagccaagagatggcccagtgacttatgaggcagaagatgccatccttactgggactacggtagacactgcacaagtgggatacacaggtagaggatacgttacaggctttgatgaaggatcagataaaatcacattccaaatttcatccgcgacaacaaaattgtacgatttgtctatcagatacgctgcaatatacggtgataaaaggacaaacgttgtgttaaacaacggcgctgttagtgaagtctttttccctgcaggtgactcttttacaagtgtggcagcaggacaagttctgcttaatgcaggacaaaatactattgacattgttaataactggggctggtacctcattgactctattacattaaccccttcagcaccaagaccaccacatgatatcaacccaaatttgaataacccaaatgcggataccaacgccaaaaagctatactcttacttaagatcagtctacggtaataagatcatctccggtcaacaggaacttcatcacgctgaatggattagacaacagacaggtaaaactccagctcttgttgcagtagatttgatggactactcaccatctagagttgaaaggggcacaacatctcatgctgtcgaggatgctatcgctcatcataatgctggtggtattgtatcagtattatggcattggaatgctccagtggggttgtatgatacagaggaaaacaaatggtggtctgggttttacactagagctaccgactttgatatagcagctactcttgctaatccacaaggagctaattacactctgttaatcagagacattgatgcaattgctgttcagctaaaaagattggaagcagccggtgtccctgttttgtggcgtccactacatgaagccgagggagggtggttctggtggggagcaaagggtccagaacctgctaaacaattgtgggacattttgtatgagagactcacagttcatcacggccttgataatctaatctgggtatggaactccatattagaagattggtatccaggtgatgatactgttgacatattgtccgccgatgtgtatgcccaaggtaatggtcctatgtcaactcaatataacgagttgatagcgctaggacgagataaaaagatgattgctgctgccgaagttggcgcagcgccactgcctggcctattgcaggcctaccaagctaattggttatggtttgctgtatggggtgacgacttcatcaataatccatcttggaataccgtcgcagtattaaacgaaatctacaacagtgattacgtcttgacgttagatgaaatacaaggttggagatcagatgatgatgacaaaggtggttctcctccttctcatcatcaccaccaccactaagg

SEQ ID NO: 475 - DNA, 8864 bp, Artificial Sequence
  pMU3170
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgccatcgaagaaaccgttatccaactcaacagccttcagtctttcaaaaaattcccagatcactttctctgtccttggaattatgcacccattgccgtctgtcgccctcctatccgcgataggagctgtcgcggcgcaagttgggccttggggccaatgtggcggaagatcctatacaggagaaacatcctgcgtatcaggctggtcttgcgtgctattcaatgaatggtattctcagtgtcaaccagccacgactacgtcaacatctagcgtatccgccacagctgctccatcatctacttcatcttctaaggaatctgttccttctgccactacttctaaaaagccagttccaactgggtctagtagttttgtaaaagccgacggtttgaagtttaacattgatggggaaactaagtactttgccggcacaaatgcatactggttgccattcctaaccaatgacgctgatgttgattcagtgatggataacttacaaaaagcaggtttaaagattttgagaacatggggttttaacgatgttaattctaagccttccagcggaactgtgtacttccaattgcatgatccaagtaccggaacaaccacgattaatacaggtgcagacgggcttcaaaggttagactacgttgttagcgctgctgagaagagaggtatcaaattactcattcctttagtcaataattgggatgattacggaggtatgaatgcttacgttaaggcatacggtggaagtaaaactgagtggtacacaaactctaaaatacaatcagtttaccaagcctatatcaaggccgttgtctcacgttacagagattctccagcaatcatggcatgggaactgtctaacgaggcaagatgccaaggctgcagtacagacgttatctacaactggactgcaaaaacatcagcttacattaagtcactcgatcctaatcacatggtagcaaccggcgatgaaggtatgggtgtcactgtggactctgatggcagctacccatattcaacctatgaaggctctgacttcgctaaaaatcttgcagctccagacatcgactttggtgtatttcatctgtataccgaagattggggtataaaggataactcatggggtaacggttgggtgacatctcatgctaaagtgtgtaaagcggctggtaaaccatgtctatttgaggaatacggattgaaagatgatcattgttcagcttcattgacttggcagaaaacttccgtatcatctggcatggcagctgatttgttttggcaatatgggcaaacactgagtacaggaccttcaccaaatgaccattttacaatctactacggtacaagtgattggcaatgtggtgttgctgatcatttgtctactctggatgatgatgacaaaggtggttctcctccttctcatcatcaccaccaccactaagg

SEQ ID NO: 476 - DNA, 8615 bp, Artificial Sequence
  pMU3130
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaagctttccaacgccctcctcaccctggctagcctggcgctggccaatgtttcaactgcgttaccaaaagccagtccagcaccttctacatcttcatcagctgctagtacttcatttgcatctacctcaggtttgcaattcaccattgatggggaaacaggttacttcgctggcactaactcttactggataggtttcctaacagacaatgctgacgttgatctagtcatgggccatctaaaatcatctggccttaaaatccttagagtatggggttttaacgacgtgacatctcaaccaagttcaggaacagtgtggtaccaattgcaccaagatggtaagtctactattaacacaggcgcagatggtttgcagagactagattacgttgtttcctccgcagaacaacatgacataaagttaatcatcaattttgtgaattactggactgattacggagggatgtcagcatacgttagtgcttacggaggctctggagagacagacttctatacctctgatacaatgcaatccgcttatcagacatatatcaaaacagtagtggaaagatactcaaacagttctgcagtattcgcttgggaattagcaaatgagccacgttgcccaagctgtgatacatctgttttgtataattggatagaaaagacctccaagtttatcaaaggtttagatgctgacagaatggtttgtattggtgatgaaggctttggcctgaatattgattctgatgggtcatacccttaccaattttccgaaggattgaactttactatgaacttggatattgatactatcgattttggtactttacatttgtacccagatagctggggaacgtctgacgattggggtaatggttggatcacagcacatggcgctgcctgtaaagcggcagggaaaccatgcttgttagaagagtacggtgtcactagcaatcattgctcagtcgaaggcgcctggcaaaagactgctctttctactacaggtgtaggtgcagacttattctggcaatacggagatgacttgtcaacgggaaaatcccctgatgacgggaataccatctactatggtacatcagattatcagtgtctagtcactgaccatgttgctgccattggatctgccgatgatgatgacaaaggtggttctcctccttctcatcatcaccaccaccactaagg

SEQ ID NO: 477 - DNA, 8570 bp, Artificial Sequence
  pMU3132
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaaagctatcttcaccctcggtctcagcctgctgtccgcggcgcaagccttgccatctgctagagcagccgcatctagcacagtggatgggactagattttccattgatggaaaaacagggtacttcgccggaactaactcatattggataggcttccttaccaataatcaagacatcgacacaacactagatcatatagctacaagtggtctaaagatcctcagagtttggggtttcaatgatgtaaacactaagccaggtgctggaactgtctggtttcaattgttgagttcctccgggagtcagattaacacaggaacagatggtttacaaagattggactacgtggtacagtccgcagaaaagaggggagttaagttgattatcaatttcgtcaacttttgggacgactatggcgggatgaacgcctacgttaaggcttttggtggatcaaaggaatcttggtacactaacgcaaatgcccaagcacagtacaaaaagtacattgaggccgttgtttctagatactctaagtctgacgcagtttttgcttgggaattggctaatgaacctcgttgtaaaggctgttctacggatgtaatatacaaatgggcaaccgatatctcagcgtacattagatcattagattcatctcacatgatcacacttggtgatgaaggcttcggtctgccaggtgatacaacctacccataccaatatacagaaggcactgatttcgtgaaaaatcttggaattaaagacttagactttggcacgtttcacatgtatccagattcctggggtgttccatattcatttggtgaaggctggatcaaatcacatgctgccgcatgtaaagctgcaggtaagccatgcttgttggaggaatacggcgcaaacgcttcatgtgatatccaaaaaccttggcaacaatcatctcttgccctagctgctgatggaatgtctggtgacctattttggcaatggggtgatcaattaagctctggacaaactcataatgatggcaatacagtatactatgggagtgagttagcgacttgcttagtcactgaccatgtcaaagctattgaagctgcatcagatgatgatgacaaaggtggttctcctccttctcatcatcaccaccaccactaagg

SEQ ID NO: 478 - DNA, 8627 bp, Artificial Sequence
  pMU3133
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaggctcattcacgctgtgcttggtcttcttgccggtgcggctcccgcccttgttgcagccagccccgcagccccaattggcaatggtagggatcaagtatctaaggcagtcggccgtcatttcgagatcgacggcaaagttcagtattttgccgggacaaattgctggtggctaggaaatctcttgaatgattttgaagtggaattggctgttagccaaattgcagagacaggttataaagtggttagaacctggggtttctttggcgttaatgatccaagtaatccaggtcaaccagtctattaccaagtcttaaacgaaagtctatacgaaggagggttaggtatcaattacggatcaaatggtattagaagattggatactgtcgtatccctagcagagagatatgatatacaattagtgctgactttcatgaataattggaacgactttggcggcatcaacatctactcaaacgcttttggatctaacgccacaacatggtatacagataaaaagtcacagagagcatacagagagtacatcaaattcatcgttaatcgttacaaaggatcttctgctatctttgcgtgggagttgggtaacgaaccaagatgtaagggttgtgacccaagtgtcatatacaactgggcaaaatccgtgtcagcatacatcaaaaagttagataagaaacacatggtagcccttggcgacgaaggttggttatgtcctccagaaggagatgggacttacgcttacgattgctctgaaggcgtcgactttgttaaaaacttggaaatagagacattggattatggtacatttcatctctacccagaatcttggggatacaattactcctggggttcagaatgggttttacaacatgacgctattggaaagagattcaacaaacctgttgtattcgaggaatatgggacgcctttgaatcatactcagctggaaagaccttggcaattgaccactgttaaggaaacacaagtcgcggctgatttcatttggcaatttggaactgttctgccagtagaaggtactgaatggggcgacgttaattcaatatactacggtaccgaggaatacgaagttctagctgtgcaacatgcttgggaaatggctagaaagaaagtaccaagacacgatgatgatgacaaaggtggttctcctccttctcatcatcaccaccaccactaagg

SEQ ID NO: 479 - DNA, 8642 bp, Artificial Sequence
  pMU3134
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaaagaaaaatacctttttttaataatatcattgagtatagtgttatgcacttcaactgaaatgaatttgggatctagtgatttcattgagcaatccctttttaactctgaaatgagcttattcccaacctttccaattagaatgaagggaatcacattcacggacgataagtactgcccagaggttccatacgattccaaagaggccttctattccttaaagcagctcgcttctaccggtgctaactacgtttccatcgtggtaacgttttaccaaaaataccataattcaactgttatctttcctttgtacacccctatcaaatctgattactatacttacgtcactgcaacagatgaagcactaactaaggtcatcaattacgcccatcaaattggattacaagtcatgctcaagccacatattgatctaattgaagatccagaatattggagaggggatattggccttaactttactcaaacacaatggaacgaatggttcgcatcttatactgactatatcttacactttgctaagatgtcagaaaagttgcaagtagaaatgtactccttgtcttgtgaattgattgaagtaagcacccaaacacagcattggatcaaattgataggtcaagttagagaagtatacacaggcatcttgactgatagttcaaattggggctacctggacggtagaggtggcgaagatactcataaagattggtggggttacgttgacgttatcggtatagactcatactatccactggcgcaggacattgatttcccaacagtcaaccaagtgatcgatgcatggcaaccagtgatcgctcgattcaaaaacctgacagaatttttcaatagacctatcatgatttctgagattgggtactgttctggacaatgtaaaagagattatatccctgttaagcaagactttacaaagcaagccatatactatcaagctgcatttgaagccttcagaaatgtagactttccattttacggctacttttggtggtcatggaatacagatcctagagatggaggcagaaaagacaattgtattacaccacagttcaaaaaggctgaggaagttctaaggcattattacggtggtcgttttagattaccaaaacttcctgggagtccagtctgcgagtgtacagttgatgatgatgacaaaggtggttctcctccttctcatcatcaccaccaccactaagg

SEQ ID NO: 480 - DNA, 8657 bp, Artificial Sequence
  pMU3135
taaacaatgaagttttcaaatatattattttgtttgtttgtactttgtacattctcacaatattgcaatgctgttatcaattggtcccaaaaagggatgacctacactaacgataagtactgtccattcgttaggtataacgacagtaaaagcgatttgtcattgtataacttaagatcaagtggtgccaattgggtttctattgtagttacaaactttcaagatacacaaaacactacggcaatctacccagtcccaggcatcacagctacagatgaggaattagaacatgctataaactacgcccataaaatcggactcaacgtgatgcttaaaccacatattgattttatgaaagatccagctcactggagaggtgaaatcggggtctactacaccgagcagcaatgggctgaatggttcgcgaattacacaccatctttggtccattacgctgaaatggccgaaaatcttaaggtggagcaattcagcttaggttgcgaactgatagctacatcttggcgtgacgcacaatggagacaggttgcaaaatctgtaagagatgtttactccggtgttttgacttacgcagctaatcatggcggtgaggaaacaaataagacttggtgggatgtcgtggacattattggtgtagatgcatactatcctctatgcccagaaacacataatgcgactctagccgacatggtcaactactggaatgtcataatgtaccaaggcgttaataacggagaggaacaaatgaccagttccttacacaatctgacagtattctggaacaaaccaatgatttttaccgaattgggctattgttctggcaattgtactactggaccagaagtagacttgggaatacaagatatccaatttcagtctgttttcgaagcattcgccaatgtcccttggtttgaaggcgttcattggtggaattgggtgactgacccagcatttggaggtgaggataactggtgtatgactccacagttcaagcctacagaagttttacttcatgaacaatatgggtcactataccctccaatcagacctaactatccagctgtgtgtccttttaatggttcaattatgaagctctactggctgttttcctactgcaagatcaagattggttacaaaaatcaatgcaaattcacttttcaaatcgttgtgattttgctagatgatgatgacaaaggtggttctcctccttctcatcatcaccaccaccactaaggcgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaat

SEQ ID NO: 481 - DNA, 8570 bp, Artificial Sequence
  pMU3136
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgttgttgcaagcttttttgtttttgttggctggttttgctgctaaaatttctgctagtctacatgcgaacttgttgttaatcaaccatcatctcgtcaacaataacgcttatagtatccacttttctatagactgtccattcgtgaaattcaatgattctcgttctgacctttcagtttcaaatctcaggtctacaggtgccaattacatcacaatagttgttactaattttcaggattccatcgacacaacaacaatctacccaacaaatttgacggctaccgatgatgagttgacacatgttatcaactacgctcatggactaggacttatggttatgttgaaaccacatattgatctaactaaggacccatcccattggagaggcgacataggtctgaattacaacgatcaagagtgggatgaatggtttacaaattacaatgcgatcttagtccattacgctcaaatgtctcagaaattgggagtggaacaattttccttaggatgtgaattgattgctacctcaccaagagattcacaatggagacaagtagccgcatccgtcagagatgtttacgatggtaagattacttacgctgcaaatcatggtggggaggaaacgaacaagacctggtgggatgttgtagactacattggtgtagacgcatactaccaacctactacactaaacgcaacattagcctcacttactgacatgtggtatgaaataatgtacgtgggactgaataatggtattgaacagatgacaacttcactttataacctgactgtcttttggaataagccaatgattttcaccgaaatcggttactgttctggcgaatgcaccttagggcctggtatcgatttggggtttcaaactgagcattttgaagcagtgtttttagcttttccagacctcaactggttccacggcgttcactggtggaattgggcaagtgatagcgccttcggtggcgataataactggtgcatgactcctcaattcaaaccaacagaagatttgattagagctgagtatggaggcactgaacaaagcgtaagacctgattatccaccactgtgcccatgtattttagatgatgatgacaaaggtggttctcctccttctcatcatcaccaccaccactaagg

SEQ ID NO: 482 - DNA, 9002 bp, Artificial Sequence
  pMU3171
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgagacaccttagctcacctccatggcctctcctccttctcctcctcctctcttctttcacctccggcgaatcatcattgtccgctgagaaaaacaagttgcatactggcggtttgtctaggcaaagtttcccaaagggttttgtctttggaacagctacctctgcttatcaagttgaaggagaaacacatcaggatggccgaggcccatccatttgggatgcctttgtgaaaatccctggtaagatcgctaaaaatgccacggctgagattactgtcgaccagtaccatcgttataaggaagatgtagacctgatgaaaaagctaaactttgatgcttacaggttctccatctcatggtctagaatttttcctgaaggttctggaaaagtgaattggaaaggtgtcgcatattacaacagacttatcgattacatggttcaaaagggcattactccatacgcaaatctgtatcattacgacttaccactagcattagagaacaaatacaagggtctacttggcaggcaagttgtaaaggattttgcagactacgctgagttctgttacaagacatttggagatagagtgaaaaattggatgacttttaatgaaccacgtgttgtcgctgctcttgggtacgataacggtatattcgcacctggcagatgttctaaagcatttggaaattgcacagaagggaatagcgccacggaaccatatatcgttactcatcatttgatactagcgcacgccgcagcagtacaaagatacagaaagtactaccaggctaaacaaaaaggcagagtgggaatcttattagatttcgtttggtatgaaccactgaccagatcaaaagctgataacttggctgctcaaagagccagagacttccatatcggatggtttatccatccactcgtttatggggaatatccaaaaacaatgcaaaatatcgttaaggaaagattgccaaagttcacagaaaaggaagtgaaaatggtaaaagggagtatagactttgtcggtattaatcaatatacaacttactacatgagtgaaccacatccaacaactaaacctaaagatttgggctatcaacaagattggaacgttgagttcggttttgctaagttaggaaaaccaataggtccacgtgcatactcaagttggttgtacaatgtcccttgggggatgtacaaagccttgatgtacatgaaagagagatacggtaatccaacaatgattttgtcagaaaacggtatggacgaccctggtaacgtaactttagcgcaaggtctacacgatacaactagaattaagtactacaaagattatttgactaatttgaaaaaggcgagagatgatggtgcaaatgtggtaggttactttgcctggtccttattagacaattttgaatggctgtcaggatacacctctagattcggcattgtttatgttgattacaaaacattgaaaagatacccaaaaatgtctgcccaatggtttaagcagttactgaagagaaacaataaggatgatgatgacaaaggtggttctcctccttctcatcatcaccaccaccactaagg

SEQ ID NO: 483 - DNA, 8969 bp, Artificial Sequence
  pMU3172
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgaatcccttcttcctactcatcttcttattcccgcggacctctcagccggtggccgctgctccagttgcaggtagcagaacagatgcaggtgggctgaacagagacaatttcccagttggttttacctttggaactgctgcttcagcataccaagttgaaggtatggcgttaaaggatggcagaggtccatccatttgggatgagtttatcaaaattccaggggaaatcaaaaacaatgccacggctgcagtcactgttgatgaatatcacagatataaagtagatattgatataatgaaaaacatgaattttgacgcttataggttctccatatcatggtctagaattttccctaatggtagtggtaaggtaaactggaagggtgtcgcttactacaacagattgattgattacatgttacaacagggaattacaccatttgcgaatctttatcattacgatctcccagaagcattagagaagagttacaatggtttgttgagccgaaacgtcgtgaaggattacgctgattacgcagaattttgtttcaagacttttggcgacagagtcaaaaattggtttacttttaacgagcctcgtgttgtagcagcgcttggctacgacaatggtatcttcgcaccaggcagatgcacaggatgtactgccggaggcaactcaaccacagaaccatacatcgtagcacacaacttgatactttctcatgcagccgctgttaaaagatatagagacaagtaccatgtttcccagaaaggtagaatcggcatcttgctggatttcgtctggtacgaacctttgacaaactctacagatgatgaagctgccgctcaaagggccagagactttcatatagggtggtttctgcatccaatcatatacggggaatatccaaaatctgtacaagatattgtcaaagagagactccctacttttacagctgaggaaatctctatagttaagggatcagttgattacttgggggttaatcaatatacatcttactacatgtttgaccctcatctaccaacacaaacgagtaccggttaccaaactgattggaacgtgggtttcgcctacgaaagagatggagttccaatcggtccaagagcgaatagtgactggttgtacattgtgccttggggaatgtacaaggccgtgacttacgttaaggaaaattaccaaaatcctactatcattctgtccgaaaatggaatggatgatccaggtaatgtctctttaacagttggagttcatgacgcaacaagattgaattactacaaatcttatatctcagagcttaaaagggctattgatgatggcgcaacagtaatcggctattttgcctggtcactactagacaattttgaatggaagttaggctacacatcaagattcggaattgtatatgtggactttaaaactttgaaacgttatccaaaaatgtcagcctactggtttaaagacgtgttacaaaagaagaaagatgatgatgacaaaggtggttctcctccttctcatcatcaccaccaccactaagg

SEQ ID NO: 484 - DNA, 8969 bp, Artificial Sequence; identical to SEQ ID NO: 483
  pMU3173

SEQ ID NO: 485 - DNA, 9002 bp, Artificial Sequence
  pMU3174
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcagagctccgtaaagctcgcggtgcttgctcttctgctagcggcagcagctcatcatggtttgttgccattaccaactgcaagatgttattggctcaatccagaaatatacgacgccggaggtctatcaaggagggcattccctgacggtttcgtttttggcactgctgcctcagcataccaagttgaaggcatggctaaacacggcggaagaggtccatcaatttgggatgcctttatagaagttccaggaacaattcctaataatgccacagctgacgtgacagttgatgaataccacagatacaaggaggatgtaaacatcatgaaaaacatgggttttgatgcatacagattttccatctcctggtccagaatatttcctgacgggacaggtaaagttaatcaggaaggcgtagactactacaacagactcattgattatatgttacagcaaggaatcgcaccatacgctaatttgtaccattacgatttgccattagcgttgcatgaacaatacttgggatggttaagtccaaagatcgtcgaagcgtttgctgattacgccgaattttgtttccatgctttcggagatcgtgtcaaaaattggttcacattcaatgaaccaagatgcgtcgcggctttaggttatgataatgggcttcatgcaccaggtagatgttcaggttgccctgctggaggtaattcaactactgagccttatcttgttgcccatcatttgatactgtctcatgcagctgccgttagacgttatagagacaagtatcaattgcaccaaaaaggtaaaattggtatcttgctagattttgtatggtacgaaccattttcagacagtaacgctgatcaagctgcagcacaacgagccagagactttcacctaggttggttcctggacccaattgtacacggaagatacccatactctatgcaagagattgcaaaagatcgattaccattattctcagatgaggaagctagaatggtcaaggggtctatcgattatgtcggcatcaaccattatacaagtttttacatgaaagatcctggcacttggaaccttacccctgtgtcttaccaagatgactggcatgtcggattcgtctacgaaaggaatggtgtacctattggcgcacatgcaaatagttactggctctacatcgtgccttggggtataaacaaagctgtttcatacgttaaggaaacttacaaaaatccaacaatgattttagccgaaaatgggatggatcaaccaggtgatgtttctatcacccaaggcgttcatgacaccgtgagaattagatactatagagattacatcactgagttgaaaaaggccatcgacgatggtgctagagtaataggatattttgcttggtctttgttggataactttgagtggagattaggctatacgtctagatttggcctagtttacgttgactacaagacactaaagagatacccaaaagatagcgccttttggttcaaacacatgctgtctaaaaagagatcagatgatgatgacaaaggtggttctcctccttctcatcatcaccaccaccactaagg

SEQ ID NO: 486 - DNA, 9014 bp, Artificial Sequence
  pMU3175
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgggccaccgcctcgtcgttgtgcttctgctggccttattagtagctggagccgcgcgcgcggccgaacaagcagccggtgaagatggaataagaggtggcgctggcgctgatcatcaagaggcagctggcatcacagggggtttatctagaagatccttcccagcaggatttgtgtttggaactgccgcttcagcctaccaggtcgagggtatggccttgaaggacggtagaggaccaagtatttgggatgcttttgtaaagacgccaggcgaaatcgcaaacaatgctacagctgacgtcaccgttgatgaatatcacagatataaggaagatgttaatatcatgaagtcaatgggttttgatgcttacagattttctataagttggagcagaatcttccctaccggcacaggtaaagtcaattggaaaggagtcgcctactataatagactcatcaactacatgttgaagattggtattacaccttacgctaatctttatcattacgacctacctgaagcactagaggtacaatacgggggattgttgaaccgtaaaatagttgaggcttttgctgattatgcggaattttgtttcaaaacattcggtgatcgtgtgaaaaattggatgactttcaatgaaccaagagtggttgccgctctgggatacgatgacggcaatttcgccccaggaaggtgtacaaaatgcacagctggtaacagtgcaactgaaccttatattgtagcacatcatttgattctgagtcatgcttccgctgtacaaaggtacagacataagtaccagcatatacaaaaaggtaaaatagggatcttattggattttgtgtggtatgagggtttaacaaactctactgctgatcaagctgcagcgcaaagatcacgagactttcatgtcggttggttcctgcatccaatcatctacggcgaatacccaaaatcacttcaagtgatcgttaaggaaagactaccaaaattcaccgccgatgaagttcacatggtaaagggttccatagactacgttggaatcaatcaatacactgcatactatgtcagagatcagcaacctaacgctacaacattgccaagctactcttctgactggcacgcggcaccaatctacgaaagagatggcgttccaatcggtccaagagctaattctgattggttgtacattgtaccttggggtttgtacaaggcagttacttatgttaaagagaaatacggtaatccaactatgtttctatctgaaaatggaatggacgatccaggcaacgttacaattgcacaaggcgtacatgatactactagagttgcttactacagatcctacattactaagttaaaggaagcaattgatgatggtgcaaactgtattggttattttgcgtggtcattattagacaattttgaatggaaactagggtacacgtcaagatttgggttggtctacgtggacttcagaacccttagaagataccctaagatgtcagcatattggtttcgtgacctcgtttcctctaaaaacgatgatgatgacaaaggtggttctcctccttctcatcatcaccaccaccactaagg

SEQ ID NO: 487 - DNA, 8510 bp, Artificial Sequence
  pMU3137
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcggtccattctggtgattccaagcttcgtagcagtactcaacgccttctctttgtttcctaaacctcatgatgatttcaaatacctaattacatttggggattcatacaccgataatgggagactgggctattacggtagccatcaggcacacggtccacctcctggtgttatgccacctgaagctaatgtgacagcttctggtggattgcaatggccacagtacgttgaggcatcaactggcgcaacgctttatgactacgccattgcgggagctacatgtgacaacaataatgtagaaagatgggcagctttcatgaacgctaattacccatcaatcattacagatgaaatcccatcttttaaagctgatagaaaaacaaaattgtatagaggagtgacttcagctaatactgtctacgccctatggataggtactaatgatttgtcttatacaggcatcttatccgactcccaagtaaagggaacaaacataacaacctacattgactgcttgtggaacgtttttgatgccatccatgcagccggtggtagaagatttgtcatacttaacaacaatgctttacaattaacaggcttataccgaccattgtctgacggtggagctggagataaccaattttggcaaaataagacgttgtataatcaaactgaatatgcgcaaaagatgcttgaatacaccacttcctctaacacaatgatcgattacggtgttccattccatctacttgtaaagaaccgttggccaggcagtaaagtcgcagtttatgatatacacagtctaattatggatatctacaatcaaccatcaaggtacctggaacctccacataatgttgtcggatactacaagcattgtgatgttaatggtactaattgtttgtacggcccaggtagattagactcatacttatggtacgacgagttgcatccaagtaatatcatcgccagttacatcgctagagagtttctcaacgtggtttctgggagatcaaaatacggcacttattgggaacattgggatgatgatgacaaaggtggttctcctccttctcatcatcaccaccaccactaagg

SEQ ID NO: 488 - DNA, 8495 bp, Artificial Sequence
  pMU3139
cgcgccctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaagaattcttaattaaacaatgcgtttcacctggatcctcgccggcgcctcgttcgcgctggccaagccaacaaaaggcggcttcgaaactttagttacatttggtgactcatacactgataatgggcgtttaggatactacatcaataacgggggtaaagccccacctccagggaagatgcatgacgaatctacaactactgcttctggtggcctatcatgggctcaatttgctgcaaaagatgctggtgctcaacttagagattatgcagtttctggtgcagtctgttctaatcaaattgttagcaggtcatttgattttatcaacagaacctttccagctattttagatgacgaactgcctagtttcgaggctgatgtggctttcaaatcactttacccaaggagaacagccgagaatacagtatacgcagtgtggattggaacaaatgacttaggctttgatgcatttttgtctgactcccaaacaagaggaaagactatatccgattttgtggactgtgtattctcagttttggacagagtatacaagactggtggtagaagatttgttctcttgaacaccgtcccattggaattgactccactatacgcacatccagataatggaggaactttggattctcaattttggaaaacaaagtctcagtataacatgaccgaatactcccagaaaataagagaatattcaacgagtgtcaacactattttggagtacggagtacctgtcaaagctagtctgcagcacagatggccaaaagccacagttgatctttttgatgtgcattccctagttaatgatatctactctgaacctatcaagtttctaaaagcaccacataacgtcaattcatattaccatcaatgtgaagttgcgggttcaccatgcgttgaccaacctggaagtttggatggttacttatggtacgatgaattacatccatccaacaagacatctgctattatcgctcaaaatttcgttgacgtcgtggtagcaggcaaatcaaagtatggtacaagattccacgatgatgatgacaaaggtggttctcctccttctcatcatcaccaccaccactaagg

SEQ ID NO: 489 - DNA, 8719 bp, Artificial Sequence
  pMU2659
ataacttcgtataatgtatgctatacgaagttattaggtgatatcagatccactagtcttctaggcgggttatctactgatccgagcttccactaggatagcacccaaacacctgcatatttggacgacctttacttacaccaccaaaaaccactttcgcctctcccgcccctgataacgtccactaattgagcgattacctgagcggtcctcttttgtttgcagcatgagacttgcatactgcaaatcgtaagtagcaacgtctcaaggtcaaaactgtatggaaaccttgtcacctcacttaattctagctagcctaccctgcaagtcaagaggtctccgtgattcctagccacctcaaggtatgcctctccccggaaactgtggccttttctggcacacatgatctccacgatttcaacatataaatagcttttgataatggcaatattaatcaaatttattttacttctttcttgtaacatctctcttgtaatcccttattccttctagctatttttcataaaaaaccaagcaactgcttatcaacacacaaacactaaatcaaattaattaaacaatgatgatgctctcaaagagtctcctttccgctgcaactgcagcctcagcgctggccgcggtactgcagcctgttccacgtgcttcgagctttgtaaccatatccggcacccaattcaacatcgatggcaaagtaggctactttgcgggcaccaactgctactggtgctcgttcctgaccaaccacgccgacgttgattccacctttagccacatctcttcctctggcctcaaggtagtccgtgtatggggcttcaacgacgtcaacacgcagccctctcccggccagatctggttccagaagctgtccgctacggggtctacgatcaacacgggagctgatgggctgcagactctcgactacgtagtccagtcagccgagcagcacaacctcaagctcatcatcccgttcgtcaacaactggagcgactacggcgggataaacgcctatgtcaacgcctttggcggcaatgcgaccacctggtacactaacacggccgcgcaaactcagtaccgcaagtacgtccaggccgtcgtcagccgctacgcaaactcgacggccatctttgcgtgggagctgggcaacgagcctcgctgcaacgggtgcagtactgatgtgattgttcagtgggcgacgagtgtgtcccaatatgtcaagtcacttgattcgaaccatctcgtgacgcttggagacgaggggctcggtctcagtactggagacggcgcttatccgtatacttatggcgagggcactgattttgccaagaatgtacaaatcaagtcgcttgactttggtactttccacctctatccggactcttggggaacaaactacacttggggcaatggctggattcagactcatgccgccgcttgtttagcagcaggcaaaccttgcgtgtttgaagaatacggcgcacagcaaaacccctgcaccaacgaggcaccctggcaaacaacctctctcacgactcgcggcatgggtggcgacatgttttggcagtggggagacacttttgccaacggtgcccagtcgaacagtgacccgtacaccgtctggtacaactcatcgaactggcaatgcttggtcaagaaccacgttgatgctattaacggcggtacaaccactcctcctcccgtatcatcgacgacgacaacctcgtctaggacctcgtcgacgcctccaccgcctgggggcagctgctcgcccttgtatggccagtgtggaggttctggatacactggtcccacgtgctgtgcgcagggaacttgtatatattccaactactggtactcgcaatgcctgaatacatgaggcgcgcctcgagagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaaagggttctaagctcaatgaagagccaatgtctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaat

SEQ ID NO: 490 - DNA, 59 bp, Artificial Sequence
  X11643
tacccgggaatcagttctgttattaacgacgagccaaattccagaaaaacagtaaggga

SEQ ID NO: 491 - DNA, 59 bp, Artificial Sequence
  X12485
gatgagagccagcttaaagagttaaaaatttcatagctaggatgtaaaatccgacacgc

SEQ ID NO: 492 - DNA, 59 bp, Artificial Sequence
  X14896
tggtggaaccatttactgtattttcaatgtaacgctagagaataaattcaagttaaaag

SEQ ID NO: 493 - DNA, 59 bp, Artificial Sequence
  X14897
acatcatcttttaacttgaatttattctctagcgttacattgaaaatacagtaaatggt

SEQ ID NO: 494 - DNA, 26 bp, Artificial Sequence
  X15458
aagcctacaggcgcaagataacacat

SEQ ID NO: 495 - DNA, 26 bp, Artificial Sequence
  X15468
gaaaccctcattacggactttctcag

SEQ ID NO: 496 - DNA, 60 bp, Artificial Sequence
  X16191
tgatgagagccagcttaaagagttaaaaatttcatagctaaaagatactagcgcgcgcac

SEQ ID NO: 497 - DNA, 59 bp, Artificial Sequence
  X17073
gaaagtatgatatgttatctttctccaataaatctacttattcccttcgagattatatc

SEQ ID NO: 498 - DNA, 59 bp, Artificial Sequence
  X17074
gttcctagatataatctcgaagggaataagtagatttattggagaaagataacatatca

SEQ ID NO: 499 - DNA, 59 bp, Artificial Sequence
  X17238
ggtcggctcttccttcttctttgcgtctgccatctttatattatcaatatttgtgtttg

SEQ ID NO: 500 - DNA, 59 bp, Artificial Sequence
  X17239
ccctccacaaacacaaatattgataatataaagatggcagacgcaaagaagaaggaaga

SEQ ID NO: 501 - DNA, 60 bp, Artificial Sequence
  X17330
ggtatataaaaatattatatggaagcaataattattactcttatgaagatggaaatggag

SEQ ID NO: 502 - DNA, 60 bp, Artificial Sequence
  X17331
ggctcaaccacaaccatatactccatttccatcttcataagagtaataattattgcttcc

SEQ ID NO: 503 - DNA, 60 bp, Artificial Sequence
  X17332
tatataaaattaaatacgtaaatacagcgtgctgcgtgctggggtagcgacggattaatg

SEQ ID NO: 504 - DNA, 61 bp, Artificial Sequence
  X17342
caaaaccagccaacaaaaacaaaaaagcttgcaacaacattattgatatagtgtttaagcg

SEQ ID NO: 505 - DNA, 26 bp, Artificial Sequence
  X17404
atgagagctttgtctgttttttttgc

SEQ ID NO: 506 - DNA, 60 bp, Artificial Sequence
  X17405
gctttaatgttctttaggtatatatttaagagcgatttgtttataagcattgagaatacc

SEQ ID NO: 507 - DNA, 64 bp, Artificial Sequence
  X17406
ttgtactgttgttaatgcttggtattctcaatgcttataaacaaatcgctcttaaatatatacc

SEQ ID NO: 508 - DNA, 60 bp, Artificial Sequence
  X17407
tatataaaattaaatacgtaaatacagcgtgctgcgtgctgcacgttaaggacggccact

SEQ ID NO: 509 - DNA, 60 bp, Artificial Sequence
  X17412
agaaacagaacaaagcaaaaaaaacagacaaagctctcattattgtaatatgtgtgtttg

SEQ ID NO: 510 - DNA, 60 bp, Artificial Sequence
  X19753
gcgaaggaaaggaaaataattgaaggaggaggcagagaacggatgtaaaatccgacacgc

SEQ ID NO: 511 - DNA, 60 bp, Artificial Sequence
  X19754
tgcgtgtgtatatgcctgttcattgcctgtccgcctctcattggggtagcgacggattaa

SEQ ID NO: 512 - DNA, 60 bp, Artificial Sequence
  X19756
aaggaaaataattgaaggaggaggcagagaaccgatttttttctaaaccgtggaatattt

SEQ ID NO: 513 - DNA, 60 bp, Artificial Sequence
  X19757
cgtgtgtatatgcctgttcattgcctgtccgcctctcatttttcaatcattggagcaatc

SEQ ID NO: 514 - DNA, 60 bp, Artificial Sequence
  X19762
gcgaaggaaaggaaaataattgaaggaggaggcagagaacaaagatactagcgcgcgcac

SEQ ID NO: 515 - DNA, 60 bp, Artificial Sequence
  X19763
cgtgtgtatatgcctgttcattgcctgtccgcctctcattgcacgttaaggacggccact

SEQ ID NO: 516 - DNA, 21 bp, Artificial Sequence
  X19812
atgaagctgatttggcctacg

SEQ ID NO: 517 - DNA, 60 bp, Artificial Sequence
  X19813
tcatcatcaccaccaccactaagattaatataattatataaaaatattatcttcttttct

SEQ ID NO: 518 - DNA, 60 bp, Artificial Sequence
  X19814
tccttctcatcatcaccaccaccactaagattaatataattatataaaaatattatcttc

SEQ ID NO: 519 - DNA, 60 bp, Artificial Sequence
  X19815
gtgtatatgcctgttcattgcctgtccgcctctcatttttaataacagtaattgaaaagc

SEQ ID NO: 520 - DNA, 60 bp, Artificial Sequence
  X19818
gggccgtaaagagaagagacgtaggccaaatcagcttcattgtgatgatgttttatttgt

SEQ ID NO: 521 - DNA, 60 bp, Artificial Sequence
  X20251
gttgcatcaattgttcatcgacttggacttctggtggggctaaagctggagaagcaacaa

SEQ ID NO: 522 - DNA, 60 bp, Artificial Sequence
  X20252
cctcgaaggttttcttttgcgtgtcggattttacatccatagaatctgacgacgtaagga

SEQ ID NO: 523 - DNA, 60 bp, Artificial Sequence
  X20253
gtttcccgctttttcttctccttacgtcgtcagattctatggatgtaaaatccgacacgc

SEQ ID NO: 524 - DNA, 60 bp, Artificial Sequence
  X20254
acaaggtgtgcaattgttatgagtaggattcagttataattaggggtagcgacggattaa

SEQ ID NO: 525 - DNA, 60 bp, Artificial Sequence
  X20255
tcccaacaacaagtatgccattaatccgtcgctacccctaattataactgaatcctactc

SEQ ID NO: 526 - DNA, 46 bp, Artificial Sequence
  X20256
gatataatatgagctcctagtgtaggcgatgaaggtgctcaagtaa

SEQ ID NO: 527 - DNA, 18 bp, Artificial Sequence
  X20353
ggccaaccataagaaagg

SEQ ID NO: 528 - DNA, 59 bp, Artificial Sequence
  X20354
caaggagggtattctgggcctccatgtcgctggccgggtatagaatctgacgacgtaag

SEQ ID NO: 529 - DNA, 60 bp, Artificial Sequence
  X20355
gtttcccgctttttcttctccttacgtcgtcagattctatacccggccagcgacatggag

SEQ ID NO: 530 - DNA, 58 bp, Artificial Sequence
  X20356
ggtgtgcaattgttatgagtaggattcagttataattaggcatcagagcagattgtac

SEQ ID NO: 531 - DNA, 59 bp, Artificial Sequence
  X20357
gtggtatggtgcactctcagtacaatctgctctgatgcctaattataactgaatcctac

SEQ ID NO: 532 - DNA, 17 bp, Artificial Sequence
  X20358
gaactggcacaaacctc

SEQ ID NO: 533 - DNA, 60 bp, artificial sequence
  X20513
cataactaattacatgatatcgacaaaggaaaaggggcctgtcgcgccttataactagag

SEQ ID NO: 534 - DNA, 60 bp, Artificial Sequence
  X20514
catacactgctatcgcaaatgctctctagttataaggcgcgacaggccccttttcctttg

SEQ ID NO: 535 - DNA, 55 bp, Artificial Sequence
  X21041
gcctactgcttagctgtttccgtctctacttctttaataacagtaattgaaaagc

SEQ ID NO: 536 - DNA, 60 bp, Artificial Sequence
  X21042
cttctatattttaatattgcttttcaattactgttattaaagaagtagagacggaaacag

SEQ ID NO: 537 - DNA, 20 bp, Artificial Sequence
  X21043
catggtgacagggggaatgg

SEQ ID NO: 538 - DNA, 18 bp, Artificial Sequence
  X21044
ctactcaccaatatcttc

SEQ ID NO: 539 - DNA, 57 bp, Artificial Sequence
  X21045
ggataagcctactgcttagctgtttccgtctctacttctcgacactggatggcggcg

SEQ ID NO: 540 - DNA, 58 bp, Artificial Sequence
  X21046
gctgtcgattcgatactaacgccgccatccagtgtcgagaagtagagacggaaacagc

SEQ ID NO: 541 - DNA, 20 bp, Artificial Sequence
  X21331
gactcattcattatgtcgtc

SEQ ID NO: 542 - DNA, 60 bp, Artificial Sequence
  X21332
gtcaaggagggtattctgggcctccatgtcgctggccgggtgttctctgcctcctccttc

SEQ ID NO: 543 - DNA, 60 bp, Artificial Sequence
  X21333
gcgaaggaaaggaaaataattgaaggaggaggcagagaacacccggccagcgacatggag

SEQ ID NO: 544 - DNA, 60 bp, Artificial Sequence
  X21334
cgtgtgtatatgcctgttcattgcctgtccgcctctcattggcatcagagcagattgtac

SEQ ID NO: 545 - DNA, 59 bp, Artificial Sequence
  X21335
ggtatggtgcactctcagtacaatctgctctgatgccaatgagaggcggacaggcaatg

SEQ ID NO: 546 - DNA, 22 bp, Artificial Sequence
  X21336
gaagattgtctgtcatttgcgc

SEQ ID NO: 547 - DNA, 19 bp, Artificial Sequence
  X21383
gcttgttctcgtttgtccc

SEQ ID NO: 548 - DNA, 58 bp, Artificial Sequence
  X21384
cctcgaaggttttcttttgcgtgtcggattttacatccatagaatctgacgacgtaag

SEQ ID NO: 549 - DNA, 60 bp, Artificial Sequence; identical to SEQ ID NO: 523
  X21385

SEQ ID NO: 550 - DNA, 58 bp, Artificial Sequence
  X21386
gacgaagcttgtgtgtgggtgcgcgcgctagtatctttggggtagcgacggattaatg

SEQ ID NO: 551 - DNA, 55 bp, Artificial Sequence
  X21387
cccaacaacaagtatgccattaatccgtcgctaccccaaagatactagcgcgcgc

SEQ ID NO: 552 - DNA, 60 bp, Artificial Sequence
  X21388
gaaacaacaaaaggatatccgaaatattccacggtttagaagcacgttaaggacggccac

SEQ ID NO: 553 - DNA, 60 bp, Artificial Sequence
  X21389
ctaaacacgaattcaacaaagtggccgtccttaacgtgcttctaaaccgtggaatatttc

SEQ ID NO: 554 - DNA, 59 bp, Artificial Sequence
  X21390
gcaaatgcctattatgcagatgttataatatctgtgcggtcgacaactaaactggaatg

SEQ ID NO: 555 - DNA, 60 bp, Artificial Sequence
  X21391
gacttttgttgttccctcacattccagtttagttgtcgaccgcacagatattataacatc

SEQ ID NO: 556 - DNA, 58 bp, Artificial Sequence
  X21392
gccggaaaaactttcgggtagcgaaaatctttctgcccttgttaaatatttcaggaac

SEQ ID NO: 557 - DNA, 60 bp, Artificial Sequence
  X21393
ccaccaaggagaggaggatgttcctgaaatatttaacaagggcagaaagattttcgctac

SEQ ID NO: 558 - DNA, 60 bp, Artificial Sequence
  X21394
cagatggggatgaccgtagtcttatgcccccttgacgtttaataacagtaattgaaaagc

SEQ ID NO: 559 - DNA, 60 bp, Artificial Sequence
  X21395
cttctatattttaatattgcttttcaattactgttattaaacgtcaagggggcataagac

SEQ ID NO: 560 - DNA, 60 bp, Artificial Sequence
  X21396
caaggtgtgcaattgttatgagtaggattcagttataattacccttccagtgcattatgc

SEQ ID NO: 561 - DNA, 60 bp, Artificial Sequence
  X21397
caaagactcgtgctgtctattgcataatgcactggaagggtaattataactgaatcctac

SEQ ID NO: 562 - DNA, 22 bp, Artificial Sequence
  X21398
cataggcgggtaagcgttaagg

SEQ ID NO: 563 - DNA, 60 bp, Artificial Sequence
  X21650
attactgctttaggtcatccaccacgggtagtgttgaggattcttgttaaatatttcagg

SEQ ID NO: 564 - DNA, 60 bp, Artificial Sequence
  X21651
caccaaggagaggaggatgttcctgaaatatttaacaagaatcctcaacactacccgtgg

SEQ ID NO: 565 - DNA, 58 bp, Artificial Sequence
  X21652
ctatatcgacgtatgcaacgtatgtgaagccaagtagatttaggacactaattgaatc

SEQ ID NO: 566 - DNA, 50 bp, Artificial Sequence
  X21653
gacgcgggcagattcaattagtgtcctaaatctacttggcttcacatacg

SEQ ID NO: 567 - DNA, 60 bp, Artificial Sequence
  X21654
ggtgtgcaattgttatgagtaggattcagttataattacatagatgcattgtgaaaattg

SEQ ID NO: 568 - DNA, 48 bp, Artificial Sequence
  X21655
gcttcaattttcacaatgcatctatgtaattataactgaatcctactc

SEQ ID NO: 569 - DNA, 60 bp, Artificial Sequence
  X22205
ggaaacaacaaaaggatatccgaaatattccacggtttagaaggggtagcgacggattaa

SEQ ID NO: 570 - DNA, 60 bp, Artificial Sequence
  X22206
atcccaacaacaagtatgccattaatccgtcgctaccccttctaaaccgtggaatatttc

SEQ ID NO: 571 - DNA, 38 bp, Artificial Sequence; identical to SEQ ID NO: 422
  X22464

SEQ ID NO: 572 - DNA, 60 bp, Artificial Sequence
  X22465
cctcgaaggttttcttttgcgtgtcggattttacatccgttctctgcctcctccttcaat

SEQ ID NO: 573 - DNA, 60 bp, Artificial Sequence; identical to SEQ ID NO: 510
  X22466

SEQ ID NO: 574 - DNA, 60 bp, Artificial Sequence; identical to SEQ ID NO: 431
  X22469

SEQ ID NO: 575 - DNA, 60 bp, Artificial Sequence
  X22478
gtgtgtatatgcctgttcattgcctgtccgcctctcattgtcgacaactaaactggaatg

SEQ ID NO: 576 - DNA, 60 bp, Artificial Sequence
  X22479
cttttgttgttccctcacattccagtttagttgtcgacaatgagaggcggacaggcaatg

SEQ ID NO: 577 - DNA, 8288 bp, Artificial Sequence
  pMU2877
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggtaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactcataagtgtaccgaagactgcattgaaagtttatgttttttcactggaggcgtcattttcgcgttgagaagatgttcttatccaaatttcaactgttatatagaagagcaaaaaattgccaaaaaaaacaacatttattcatttgaaatataaaatttgggcttctatattttaatattgcttttcaattactgttattaaacctgatgcggtattttctccttacgcatctgtgcggtatttcacaccgcatagggtaataactgatataattaaattgaagctctaatttgtgagtttagtatacatgcatttacttataatacagttttctactcaccaatatcttcaaaccaatcctgaggtctttcatcgataaattgtttcatgatctttttacacctctcatcgtcaacaacaacaacctcgtgacctctagtttgtaaatatttctcgcccttacttttgaaattaacgttctcaccgacaacacagcgtggaataccatacatgatgatggcacctgtacacatgtcgcatggagacagcgtcgtatacaaagtggtatctttgtacactttgccctctaatctcccacagttttccaaagtggagatctcaccatgtagtgtggcggatcccttttgaaatctcatgttgtgaccacgaccgagaacacttccgtctttgttattgataagacatccgccaataggaacaccaccctctttgtaacctaaggccgcctcctcataggcaatgtccatacccttctgatcccacttgcttgccattccccctgtcaccatgatttatcttcgtttcctgcaggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaattgaaaagctgtggtatggtgcactctcagtacaatctgctctgatgccgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 578 - DNA, 10629 bp, Artificial Sequence
  pMU2745
cgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactagtgtttaaacacctcatctataatttttaccctgatctaactaactttggcatgcctggttcaatctacgggttacagtcatcgttgaaaacgatggaaaaacatgtcgagattcctcaatccatacaccattatagtccgttttatcagcttccactaattttttaaatctcagtttcttcttgaaatttagcatcgtgcatgggatagcggctagtaaaaaagaaaattaatatctcattaacaaagttattgtacataatccggtacaatattcttcaatgtactctctaatatcgagcacactggcaatattcatgcacacattcgcctaatgctgacgaatgcttaatcagtgcaattactgccaccctcttgatatgtgggctaaatcctttaggacctgtaaaaaatgcaatcacgttttcacatttttttttttcttgcggaattgcggaatttcccagttggcagcgttatccgatttgagatcgacttgcatcaacctttgaaaaatataaggatgagaaagtgaaatcggttttttttttccattgtcgtcatcaacatgattttttaaataaataaatacgattttttattttttttcccttctttgtttttgttttgcttattcccatcttcattattaaattcttccgctcttaataaaggagtttttttattatcttcttgtgtaatcatcctttttctttaattttcttccttttctttttctctttactggtttttttacttctttattctcaaccatctaaagaatattattgctttctaccaataaaatctgttaattctatttggattgtcgtctactcaagtctcgcctagtaaataaacgataaacaaatttgaagtaagaataacaatatagggagagaaatttttctatttttaatttcgaaacaggtaccaaaaaatctaagttcactttagcactatttgggaaagcttttatataaaaaatctgaaacaaaatcatatcaaagatggcagacgcaaagaagaaggaagagccgaccaagccgactccggaagagaagctcgccgcagccgaggctgaggtcgacgctctggtcaagaagggcctgaaggctcttgatgaattcgagaagctcgatcagaagcaggttgaccacatcgtggccaaggcttccgtcgcagccctgaacaagcacttggtgctcgccaagatggccgtcgaggagacccaccgtggtctggtcgaagacaaggccaccaagaacatcttcgcctgcgagcatgtcaccaactacctggctggtcagaagaccgtcggcatcatccgcgaggacgacgtgctgggcatcgacgaaatcgccgagccggttggcgtcgtcgctggcgtgaccccggtcaccaacccgacctccaccgccatcttcaagtcgctgatcgcactgaagacccgctgcccgatcatcttcggcttccacccgggcgcacagaactgctccgtcgcggccgccaagatcgttcgcgatgccgctatcgcagcaggcgctcctgagaactgtattcagtggatcgagcatccgtccatcgaggccactggcgccctgatgaagcatgatggtgtcgccaccatcctcgccaccggtggtccgggcatggtcaaggccgcatactcctccggcaagccggccctgggcgtcggcgcgggcaatgctccggcatacgttgacaagaacgtcgacgtcgtgcgtgcagccaacgatctgattctttccaagcacttcgattacggcatgatctgcgctaccgagcaggccatcatcgccgacaaggacatctacgctccgctcgttaaggaactcaagcgtcgcaaggcctatttcgtgaacgctgacgagaaggccaagctcgagcagtacatgttcggctgcaccgcttactccggacagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgctccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtggagaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcattccgacttcttccggcaccggttccgaagtcacgccgttcgctgtgattaccgaccacaagaccggctataagtacccgatcaccgattacgcgctgaccccgtccgtcgctatcgtcgatccggtgctggcacgtactcagccgcgcaagctggcttccgatgctggtttcgatgctctgacccacgcttttgaggcttatgtgtccgtgtatgccaacgacttcaccgatggtatggcattgcacgctgccaagctggtttgggacaacctcgctgagtccgtcaatggcgagccgggtgaggagaagacccgtgcccaggagaagatgcataatgccgccaccatggccggcatggctttcggctccgccttcctcggcatgtgccacggcatggcccacaccattggtgcactgtgccacgttgcccacggtcgtaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggctgttgaggattaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatactaaacaagaccaacataataatggtggaaccatttactgtattttcaatgtaacatttaaatccgcggtaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgatac

SEQ ID NO: 579 - DNA, 10052 bp, Artificial Sequence
  pMU2746
caagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatccaggatcccaattaatgtgagttacctcactcattaggcaccccaggctttacactttatgcttccggctcgtatgttgtgtggaattgtgagcggataacaatttcacacaggaaacagctatgaccatgattacgaattaattcgagctcggtacccggggatcgatccactagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatggccgaccaagcgacgcccaacctgccatcacgagatttcgattccacggccgccttctatgaaaggttgggcttcggaatcgttttccgggacgccggctggatgatcctccagcgcggggatctcaagctggagttcttcgcccaccccgggctcgatcccctcgcgagttggttcagctgctgcctgaggctggacgacctcgcggagttctaccggcagtgcaaatccgtcggcatccaggaaaccagcagcggctatccgcgcatccatgcccccgaactgcaggagtggggaggcacgatggccgctttggtcgacccggacgggacgctcctgcgcctgatacagaacgaattgcttgcaggcatctcatgatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatataacttcgtataatgtatgctatacgaagttattaggtgatatcagatccactacttattcccttcgagattatatctaggaacccatcaggttggtggaagattacccgttctaagacttttcagcttcctctattgatgttacacctggacaccccttttctggcatccagtttttaatcttcagtggcatgtgagattctccgaaattaattaaagcaatcacacaattctctcggataccacctcggttgaaactgacaggtggtttgttacgcatgctaatgcaaaggagcctatatacctttggctcggctgctgtaacagggaatataaagggcagcataatttaggagtttagtgaacttgcaacatttactattttcccttcttacgtaaatatttttctttttaattctaaatcaatctttttcaattttttgtttgtattcttttcttgcttaaatctataactacaaaaaacacatacataaactaaaaatggcagacgcaaagaagaaggaagagccgaccaagccgactccggaagagaagctcgccgcagccgaggctgaggtcgacgctctggtcaagaagggcctgaaggctcttgatgaattcgagaagctcgatcagaagcaggttgaccacatcgtggccaaggcttccgtcgcagccctgaacaagcacttggtgctcgccaagatggccgtcgaggagacccaccgtggtctggtcgaagacaaggccaccaagaacatcttcgcctgcgagcatgtcaccaactacctggctggtcagaagaccgtcggcatcatccgcgaggacgacgtgctgggcatcgacgaaatcgccgagccggttggcgtcgtcgctggcgtgaccccggtcaccaacccgacctccaccgccatcttcaagtcgctgatcgcactgaagacccgctgcccgatcatcttcggcttccacccgggcgcacagaactgctccgtcgcggccgccaagatcgttcgcgatgccgctatcgcagcaggcgctcctgagaactgtattcagtggatcgagcatccgtccatcgaggccactggcgccctgatgaagcatgatggtgtcgccaccatcctcgccaccggtggtccgggcatggtcaaggccgcatactcctccggcaagccggccctgggcgtcggcgcgggcaatgctccggcatacgttgacaagaacgtcgacgtcgtgcgtgcagccaacgatctgattctttccaagcacttcgattacggcatgatctgcgctaccgagcaggccatcatcgccgacaaggacatctacgctccgctcgttaaggaactcaagcgtcgcaaggcctatttcgtgaacgctgacgagaaggccaagctcgagcagtacatgttcggctgcaccgcttactccggacagaccccgaagctcaactccgtggtgccgggcaagtccccgcagtacatcgccaaggccgccggcttcgagattccggaagacgccaccatccttgccgctgagtgcaaggaagtcggcgagaacgagccgctgaccatggagaagcttgctccggtccaggccgtgctgaagtccgacaacaaggaacaggccttcgagatgtgcgaagccatgctgaagcatggcgccggccacaccgccgccatccacaccaacgaccgtgacctggtccgcgagtacggccagcgcatgcacgcctgccgtatcatctggaactccccgagctccctcggcggcgtgggcgacatctacaacgccatcgctccgtccctgaccctgggctgcggctcctacggcggcaactccgtgtccggcaacgtccaggcagtcaacctcatcaacatcaagcgcatcgctcggaggaacaacaacatgcagtggttcaagattccggccaagacctacttcgagccgaacgccatcaagtacctgcgcgacatgtacggcatcgaaaaggccgtcatcgtgtgcgataaggtcatggagcagctcggcatcgttgacaagatcatcgatcagctgcgtgcacgttccaaccgcgtgaccttccgtatcatcgattatgtcgagccggagccgagcgtggagaccgtcgaacgtggcgccgccatgatgcgcgaggagttcgagccggataccatcatcgccgtcggcggtggttccccgatggatgcgtccaagattatgtggctgctgtacgagcacccggaaatctccttctccgatgtgcgtgagaagttcttcgatatccgtaagcgcgcgttcaagattccgccgctgggcaagaaggccaagctggtctgcattccgacttcttccggcaccggttccgaagtcacgccgttcgctgtgattaccgaccacaagaccggctataagtacccgatcaccgattacgcgctgaccccgtccgtcgctatcgtcgatccggtgctggcacgtactcagccgcgcaagctggcttccgatgctggtttcgatgctctgacccacgcttttgaggcttatgtgtccgtgtatgccaacgacttcaccgatggtatggcattgcacgctgccaagctggtttgggacaacctcgctgagtccgtcaatggcgagccgggtgaggagaagacccgtgcccaggagaagatgcataatgccgccaccatggccggcatggctttcggctccgccttcctcggcatgtgccacggcatggcccacaccattggtgcactgtgccacgttgcccacggtcgtaccaactccatcctcctgccgtacgtgatccgttacaacggttccgtcccggaggagccgaccagctggccgaagtacaacaagtacatcgctccggaacgctaccaggagatcgccaagaaccttggcgtgaacccgggcaagactccggaagagggcgtcgagaacctggccaaggctgttgaggattaccgtgacaacaagctcggtatgaacaagagcttccaggagtgcggtgtggatgaggactactattggtccatcatcgaccagatcggcatgcgcgcctacgaagaccagtgcgcaccggcgaacccgcgtatcccgcagatcgaggatatgaaggatatcgccattgccgcctactacggcgtcagccaggcggaaggccacaagctgcgcgtccagcgtcagggcgaagccgctacggaggaagcttccgagcgcgcctgagttaattcaaattaattgatatagttttttaatgagtattgaatctgtttagaaataatggaatattatttttatttatttatttatattattggtcggctcttttcttctgaaggtcaatgacaaaatgatatgaaggaaataatgatttctaaaattttacaacgtaagatatttttacaaaagcctagctcatcttttgtcatgcactattttactcacgcttgaaattaacggccagtccactgcggagtcatttcaaagtcatcctaatcgatctatcgtttttgatagctcattttggagttcgcgattgtcttctgttattcacaactgttttaatttttatttcattctggaactcttcgagttctttgtaaagtctttcatagtagcttactttatcctccaacatatttaacttcatgtcaatttcggctcttaaattttccacatcatcaagttcaacatcatcttttaacttgaatttattctctagctaaacctctttgcgggcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcataggagatctaagctctggcgtaatagcgaagaggcccgcaccgatcgcccttcccaacagttgcgcagcctgaatggcgaatggcgcctgatgcggtattttctccttacgcatctgtgcggtatttcacaccgcatagggtaataactgatataattaaattgaagctctaatttgtgagtttagtatacatgcatttacttataatacagttttttagttttgctggccgcatcttctcaaatatgcttcccagcctgcttttctgtaacgttcaccctctaccttagcatcccttccctttgcaaatagtcctcttccaacaataataatgtcagatcctgtagagaccacatcatccacggttctatactgttgacccaatgcgtctcccttgtcatctaaacccacaccgggtgtcataatcaaccaatcgtaaccttcatctcttccacccatgtctctttgagcaataaagccgataacaaaatctttgtcgctcttcgcaatgtcaacagtacccttagtatattctccagtagatagggagcccttgcatgacaattctgctaacatcaaaaggcctctaggttcctttgttacttcttctgccgcctgcttcaaaccgctaacaatacctgggcccaccacaccgtgtgcattcgtaatgtctgcccattctgctattctgtatacacccgcagagtactgcaatttgactgtattaccaatgtcagcaaattttctgtcttcgaagagtaaaaaattgtacttggcggataatgcctttagcggcttaactgtgccctccatggaaaaatcagtcaagatatccacatgtgtttttagtaaacaaattttgggacctaatgcttcaactaactccagtaattccttggtggtacgaacatccaatgaagcacacaagtttgtttgcttttcgtgcatgatattaaatagcttggcagcaacaggactaggatgagtagcagcacgttccttatatgtagctttcgacatgatttatcttcgtttcggtttttgttctgtgcagttgggttaagaatactgggcaatttcatgtttcttcaacactacatatgcgtatatataccaatctaagtctgtgctccttccttcgttcttccttctgttcggagattaccgaatcaaaaaaatttcaaagaaaccgaaatcaaaaaaaagaataaaaaaaaaatgatgaattgaaaagctcttgttacccatcattgaattttgaacatccgaacctgggagttttccctgaaacagatagtatatttgaacctgtataataatatatagtctagcgctttacggaagacaatgtatgtatttcggttcctggagaaactattgcatctattgcataggtaatcttgcacgtcgcatccccggttcattttctgcgtttccatcttgcacttcaatagcatatctttgttaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagac

SEQ ID NO: 580 - DNA, 9462 bp, Artificial Sequence
  pMU2873
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggtaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatgttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatgatacacggtccaatggataaacattttttatcaacactatgatatataaatataatagtttttcgtatatatattcctttttttggtcaatttttgaaattttcgtagaaaagggagagacaaaacacattatatcaatgaaaacgtacaaaaagtagataaagtcagtgcttaaacacgtcttttccttaaaaatactttattatttttattttattgagagggtggtttaaaaatagaaatagagagagaggtacatacataaacatacgcgcacaaaagcagagattagttggcttcacccatttccctagcgaaagtcctggccagatcgcagatcgttggaatagaccctggtgttgttacatgagtttgtaccatgcctgatgtcaattgtaacagtgcatctctgcatccagcaggagattgatcgtaatctaagatgaaaacatgcatggatctcaatcgcttcgctaggacatcaagggcccatgcgaacacgttatagaggtcgccgtttggagccaacagctctggagctctgaagagagtaaagagggtgtccccaatgtgtggtcttggccctgcattactctgtggctctgcgccttgtggaggaactgcagtgccagaaagttgaccccaatcttctctccagcttccaccacattgtaagtacctaaccgtatttgccaatagtccatagacacgtcttattgccgcgagcatagctaagtccaatcgctcgccaggtctttgtctcttagccagtctatcaatatgtctatcttcaggcagagctcctaacacgatgttggtccctggcaatgtaggtggtataagtgcaacaaaagcaagcacagcctgaggagtcattgaacccattaggtatctggcagcaggataacaaagcaatgccgcgattgggtgtctatcgaatatcaatgtgagtgctggtggtggggcatgacttgaaccagcttctccgccaatatgtggggccaaaacagcatcagttacggcgtaaggcatgcccatggttatctgtgcagaagtcataacaacagccgcatcaccagcggagatttcaccttgatctaatctatgttgggtggtgtagatgtttgcgatcgtttctgaggcacctagaactctccagtaggtcataggctctggaacatagacaatatcatctctagatcccaaagcgactagtaattgtgtagttgttgttttacccataccgtgtggaccgtcgatgtagactctaagtagtgttggcatcttttgttctggtcttacttcagttgcttcctgttgtctacgaggacgcaaagctgttctcctattagaatgtcctctagatctcgcggcttgatcaaaagcggatgcatgttggtgaccaggatatgaagccattatgttgctttataagtctttttgtaatttaatttgttgttcttataatctaatataagaggaattgagaaagaggaaatctcaaatctggttagaatgtagaattgtaatcgctttttatatcatttgtgaatccgggaacgatgacaagtttggtgggggttgctaggttttgaaaacataaaaaatgggcgacttattgttgtcgtccacgccagttgcgtggcctattactatcgttaggcggcgtaccgttaatttttccagccctgcttcgccatcgcaaaaacgaaaaggcacgcatggcttgcgaaaaactaaaatgatggaaaaacaggtggaagagccacctatctagttcccgaagaaaacgcgtaggaaaaaggatttcggaaaattttattgagttaaaagaccccgcttttctccggattcataaggattagcttaagttagcggttgcgccgtgaggagaaaaagaaacttaaaagtgaagctgcggggctgtctatgaggcgtcattttttgtgggaggagaagaagtcgtgcagtggagaaaaagaatctatttcacggaaaattatattttggtttttcctctcctcttcttcgtccccccgtttcttttctttggactatcatgtagtctcgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 581 - DNA, 9225 bp, Artificial Sequence
  pMU2879
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccataccacagcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccctatgcggtgtgaaataccgcacagatgcgtaaggagaaaataccgcatcaggaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcgcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgagcgcgcgtaatacgactcactatagggcgaattgggtaccgggccccccctcgaggtcgacggtatcgataagcttgatatcgaattcctgcagcccgggtaggtctagagatctgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaccatgggtaccactcttgacgacacggcttaccggtaccgcaccagtgtcccgggggacgccgaggccatcgaggcactggatgggtccttcaccaccgacaccgtcttccgcgtcaccgccaccggggacggcttcaccctgcgggaggtgccggtggacccgcccctgaccaaggtgttccccgacgacgaatcggacgacgaatcggacgacggggaggacggcgacccggactcccggacgttcgtcgcgtacggggacgacggcgacctggcgggcttcgtggtcgtctcgtactccggctggaaccgccggctgaccgtcgaggacatcgaggtcgccccggagcaccgggggcacggggtcgggcgcgcgttgatggggctcgcgacggagttcgcccgcgagcggggcgccgggcacctctggctggaggtcaccaacgtcaacgcaccggcgatccacgcgtaccggcggatggggttcaccctctgcggcctggacaccgccctgtacgacggcaccgcctcggacggcgagcaggcgctctacatgagcatgccctgcccctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctctcgagaacccttaatgttttgatttggttcccagaaacaaagggtatgagcatagaagatattgataaattcttcgaatttgagagtaaagagggcaccaatttacatggggaaaagggtatcaaaacgccggactcaaattctaatggcggttctacaagatcctcccaagaagggcaattgcataaacctataaaactgaaaagcgatgaagagatgatcatatgatacacggtccaatggataaacattttttatcaacactatgatatataaatataatagtttttcgtatatatattcctttttttggtcaatttttgaaattttcgtagaaaagggagagacaaaacacattatatcaatgaaaacgtacaaaaagtagataaagtcagtgcttaaacacgtcttttccttaaaaatactttattatttttattttattgagagggtggtttaaaaatagaaatagagagagaggtacatacataaacatacgcgcacaaaagcagagattagttggcttcacccatttccctagcgaaagtcctggccagatcgcagatcgttggaatagaccctggtgttgttacatgagtttgtaccatgcctgatgtcaattgtaacagtgcatctctgcatccagcaggagattgatcgtaatctaagatgaaaacatgcatggatctcaatcgcttcgctaggacatcaagggcccatgcgaacacgttatagaggtcgccgtttggagccaacagctctggagctctgaagagagtaaagagggtgtccccaatgtgtggtcttggccctgcattactctgtggctctgcgccttgtggaggaactgcagtgccagaaagttgaccccaatcttctctccagcttccaccacattgtaagtacctaaccgtatttgccaatagtccatagacacgtcttattgccgcgagcatagctaagtccaatcgctcgccaggtctttgtctcttagccagtctatcaatatgtctatcttcaggcagagctcctaacacgatgttggtccctggcaatgtaggtggtataagtgcaacaaaagcaagcacagcctgaggagtcattgaacccattaggtatctggcagcaggataacaaagcaatgccgcgattgggtgtctatcgaatatcaatgtgagtgctggtggtggggcatgacttgaaccagcttctccgccaatatgtggggccaaaacagcatcagttacggcgtaaggcatgcccatggttatctgtgcagaagtcataacaacagccgcatcaccagcggagatttcaccttgatctaatctatgttgggtggtgtagatgtttgcgatcgtttctgaggcacctagaactctccagtaggtcataggctctggaacatagacaatatcatctctagatcccaaagcgactagtaattgtgtagttgttgttttacccataccgtgtggaccgtcgatgtagactctaagtagtgttggcatcttttgttctggtcttacttcagttgcttcctgttgtctacgaggacgcaaagctgttctcctattagaatgtcctctagatctcgcggcttgatcaaaagcggatgcatgttggtgaccaggatatgaagccattatgttgctttataagtctttttgtaatttaatttgttgttcttataatctaatataagaggaattgagaaagaggaaatctcaaatctggttagaatgtagaattgtaatcgctttttatatcatttgtgaatccgggaacgatgacaagtttggtgggggttgctaggttttgaaaacataaaaaatgggcgacttattgttgtcgtccacgccagttgcgtggcctattactatcgttaggcggcgtaccgttaatttttccagccctgcttcgccatcgcaaaaacgaaaaggcacgcatggcttgcgaaaaactaaaatgatggaaaaacaggtggaagagccacctatctagttcccgaagaaaacgcgtaggaaaaaggatttcggaaaattttattgagttaaaagaccccgcttttctccggattcataaggattagcttaagttagcggttgcgccgtgaggagaaaaagaaacttaaaagtgaagctgcggggctgtctatgaggcgtcattttttgtgggaggagaagaagtcgtgcagtggagaaaaagaatctatttcacggaaaattatattttggtttttcctctcctcttcttcgtccccccgtttcttttctttggactatcatgtagtctcgcggccgccaccgcggtggagctccagcttttgttccctttagtgagggttaattgcgcgcttggcgtaatcatggtcatagctgtttcctgtgtgaaattgttatccgctcacaattccacacaacataggagccggaagcataaagtgtaaagcctggggtgcctaatgagtgaggtaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgaacgaagcatctgtgcttcattttgtagaacaaaaatgcaacgcgagagcgctaatttttcaaacaaagaatctgagctgcatttttacagaacagaaatgcaacgcgaaagcgctattttaccaacgaagaatctgtgcttcatttttgtaaaacaaaaatgcaacgcgagagcgctaatttttcaaacaaagaatctgagctgcatttttacagaacagaaatgcaacgcgagagcgctattttaccaacaaagaatctatacttcttttttgttctacaaaaatgcatcccgagagcgctatttttctaacaaagcatcttagattactttttttctcctttgtgcgctctataatgcagtctcttgataactttttgcactgtaggtccgttaaggttagaagaaggctactttggtgtctattttctcttccataaaaaaagcctgactccacttcccgcgtttactgattactagcgaagctgcgggtgcattttttcaagataaaggcatccccgattatattctataccgatgtggattgcgcatactttgtgaacagaaagtgatagcgttgatgattcttcattggtcagaaaattatgaacggtttcttctattttgtctctatatactacgtataggaaatgtttacattttcgtattgttttcgattcactctatgaatagttcttactacaatttttttgtctaaagagtaatactagagataaacataaaaaatgtagaggtcgagtttagatgcaagttcaaggagcgaaaggtggatgggtaggttatatagggatatagcacagagatatatagcaaagagatacttttgagcaatgtttgtggaagcggtattcgcaatattttagtagctcgttacagtccggtgcgtttttggttttttgaaagtgcgtcttcagagcgcttttggttttcaaaagcgctctgaagttcctatactttctagagaataggaacttcggaataggaacttcaaagcgtttccgaaaacgagcgcttccgaaaatgcaacgcgagctgcgcacatacagctcactgttcacgtcgcacctatatctgcgtgttgcctgtatatatatatacatgagaagaacggcatagtgcgtgtttatgcttaaatgcgtacttatatgcgtctatttatgtaggatgaaaggtagtctagtacctcctgtgatattatcccattccatgcggggtatcgtatgcttccttcagcactaccctttagctgttctatatgctgccactcctcaattggattagtctcatccttcaatgctatcatttcctttgatattggatcatactaagaaaccattattatcatgacattaacctataaaaataggcgtatcacgaggccctttcgtc

SEQ ID NO: 582 - DNA, 60 bp, Artificial Sequence
  X19784
gcgaaggaaaggaaaataattgaaggaggaggcagagaacggaacaaatgcaccaaactg

SEQ ID NO: 583 - DNA, 60 bp, Artificial Sequence
  X19805
caaaaacaagccctagaagcaattgccaccgatgcatttatattattattattgtactag

SEQ ID NO: 584 - DNA, 22 bp, Artificial Sequence
  X21343
gtccactaaatggcagtaaatg

SEQ ID NO: 585 - DNA, 59 bp, Artificial Sequence
  X21344
gtcaaggagggtattctgggcctccatgtcgctggccgggttttgtttgtggggagagg

SEQ ID NO: 586 - DNA, 49 bp, Artificial Sequence
  X21345
gcttttctattcctctccccacaaacaaaacccggccagcgacatggag

SEQ ID NO: 587 - DNA, 55 bp, Artificial Sequence
  X21346
gagggaagggggaagattgtagtacttttcgagaaggcatcagagcagattgtac

SEQ ID NO: 588 - DNA, 60 bp, Artificial Sequence
  X21347
gtggtatggtgcactctcagtacaatctgctctgatgccttctcgaaaagtactacaatc

SEQ ID NO: 589 - DNA, 18 bp, Artificial Sequence
  X21348
gcctttgaacaatttccc

SEQ ID NO: 590 - DNA, 60 bp, Artificial Sequence
  X22880
gacttttgttgttccctcacattccagtttagttgtcgacggatgtaaaatccgacacgc

SEQ ID NO: 591 - DNA, 60 bp, Artificial Sequence
  X22958
gcaacctcgaaggttttcttttgcgtgtcggattttacatcctttgtttgtggggagagg

SEQ ID NO: 592 - DNA, 60 bp, Artificial Sequence
  X22959
ataaaagaaaagcttttctattcctctccccacaaacaaaggatgtaaaatccgacacgc

SEQ ID NO: 593 - DNA, 60 bp, Artificial Sequence
  X22968
tttttgcagaatagatcaacagtttggtgcatttgttccgtcgacaactaaactggaatg

SEQ ID NO: 594 - DNA, 60 bp, Artificial Sequence
  X22969
gacttttgttgttccctcacattccagtttagttgtcgacggaacaaatgcaccaaactg

SEQ ID NO: 595 - DNA, 60 bp, Artificial Sequence
  X22970
aacaacaagtatgccattaatccgtcgctacccccactgctatgtatgttgaatcatgtt

SEQ ID NO: 596 - DNA, 60 bp, Artificial Sequence
  X22972
ttactgctttaggtcatccaccacgggtagtgttgaggattctaaaccgtggaatatttc

SEQ ID NO: 597 - DNA, 60 bp, Artificial Sequence
  X22973
aaacaacaaaaggatatccgaaatattccacggtttagaatcctcaacactacccgtggt

SEQ ID NO: 598 - DNA, 60 bp, Artificial Sequence
  X22974
gagggaagggggaagattgtagtacttttcgagaaatttaggacactaattgaatctgcc

SEQ ID NO: 599 - DNA, 60 bp, Artificial Sequence
  X22975
taaaaaatgacgcgggcagattcaattagtgtcctaaatttctcgaaaagtactacaatc

SEQ ID NO: 600 - DNA, 60 bp, Artificial Sequence
  X23004
acctcgaaggttttcttttgcgtgtcggattttacatccgtcgacaactaaactggaatg

SEQ ID NO: 601 - DNA, 60 bp, Artificial Sequence
  X23150
gtagactatccacacaaacatgattcaacatacatagcagtgggggtagcgacggattaa

SEQ ID NO: 602 - protein, 17 aa, Artificial Sequence
  linker
DDDDKGGSPPSHHHHHH

We claim:

1. A recombinant yeast host cell, comprising:
    (a) a heterologous polynucleotide comprising a nucleic acid which encodes an acetylxylanesterase;
    (b) a heterologous polynucleotide comprising a nucleic acid which encodes a xylanase; and
    (c) a heterologous polynucleotide comprising a nucleic acid which encodes a xylosidase.

2. The recombinant yeast host cell of claim 1, wherein the heterologous polynucleotide of (a) comprises a nucleic acid which encodes a polypeptide comprising an amino acid sequence at least 90% identical to any one of SEQ ID NOs:6-10.

3. The recombinant yeast host cell of claim 1, wherein the heterologous polynucleotide of (b) comprises a nucleic acid which encodes a polypeptide comprising an amino acid sequence at least 90% identical to any one of SEQ ID NOs:37-62.

4. The recombinant yeast host cell of claim 1, wherein the heterologous polynucleotide of (c) comprises a nucleic acid which encodes a polypeptide comprising an amino acid sequence at least 90% identical to any one of SEQ ID NOs:78-92.

5. The recombinant yeast host cell of claim 1, wherein at least one of the acetylxylanesterase, the xylanase, or the xylosidase comprises a histidine tag.

6. The recombinant yeast host cell of claim 1, further comprising:
    (d) a heterologous polynucleotide comprising a nucleic acid which encodes a galactosidase; and either
    (e) a heterologous polynucleotide comprising a nucleic acid which encodes a mannosidase, or
    (f) a heterologous polynucleotide comprising a nucleic acid which encodes an alpha-glucuronidase.

7. The recombinant yeast host cell of claim 6, wherein the heterologous polynucleotide of (d) comprises a nucleic acid which encodes a polypeptide comprising an amino acid sequence at least 90% identical to any one of SEQ ID NOs:108-122.

8. The recombinant yeast host cell of claim 6, wherein the heterologous polynucleotide of (e) comprises a nucleic acid which encodes a polypeptide comprising an amino acid sequence at least 90% identical to any one of SEQ ID NOs:146-168.

9. The recombinant yeast host cell of claim 6, wherein the heterologous polynucleotide of (f) comprises a nucleic acid which encodes a polypeptide comprising an amino acid sequence at least 90% identical to any one of SEQ ID NOs:184-198.

10. The recombinant yeast host cell of claim 1, further comprising:
(d) a heterologous polynucleotide comprising a nucleic acid which encodes an acetyl esterase; and
(e) a heterologous polynucleotide comprising at least one of a nucleic acid which encodes a beta-glucosidase, an endoglucanase, and an alpha-glucoronidase.

11. The recombinant yeast host cell of claim 10, wherein the heterologous polynucleotide of (d) comprises a nucleic acid which encodes a polypeptide comprising an amino acid sequence at least 90% identical to any one of SEQ ID NOs:223-225.

12. The recombinant yeast host cell of claim 10, wherein the heterologous polynucleotide that encodes the alpha-glucoronidase comprises a nucleic acid which encodes a polypeptide comprising an amino acid sequence at least 90% identical to any one of SEQ ID NOs:185-198.

13. The recombinant yeast host cell of claim 10, wherein the heterologous polynucleotide that encodes the beta-glucosidase comprises a nucleic acid which encodes a polypeptide comprising an amino acid sequence at least 90% identical to any one of SEQ ID NOs:92, 164-168, 226 and 227.

14. The recombinant yeast host cell of claim 10, wherein the heterologous polynucleotide that encodes the endoglucanase comprises a nucleic acid which encodes a polypeptide comprising an amino acid sequence at least 90% identical to any one of SEQ ID NOs:289-345.

15. The recombinant yeast host cell of claim 1, wherein at least one of the heterologous polynucleotides is expressed.

16. The recombinant yeast host cell of claim 1, wherein at least one of the heterologous polynucleotides express a polypeptide that is secreted by the recombinant yeast host cell.

17. The recombinant yeast host cell of claim 1, wherein the recombinant yeast host cell ferments a lignocellulosic material to produce a fermentation product comprising at least one of ethanol, lactic acid, hydrogen, butyric acid, acetone, and butanol.

18. The recombinant yeast host cell of claim 17, wherein the lignocellulosic material is insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, or agave.

19. The recombinant yeast host cell of claim 17, wherein the recombinant yeast host cell ferments at least about 20% of xylo-oligomers in the lignocellulosic material.

20. The recombinant yeast host cell of claim 17, wherein about 20% to about 80% of xylo-oligomers in the lignocellulosic material are hydrolyzed to monomers during fermentation of the recombinant yeast host cell.

21. The recombinant yeast host cell of claim 17, wherein the yeast strain has a specific growth rate ($h^{-1}$) of at least about 0.05 in a culture medium containing xylose as the primary sugar source.

22. The recombinant yeast host cell of claim 21, wherein the xylose in the culture medium is fermented in about 40 hours or less and is at an initial concentration of at least 30 g/L.

23. The recombinant yeast host cell of claim 1, wherein fermentation of the recombinant yeast host cell produces an ethanol yield of at least about 15% more ethanol than is produced by a nonrecombinant yeast.

24. The recombinant yeast host cell of claim 1, wherein the recombinant yeast host cell further comprises a deletion or alteration of one or more glycerol producing enzymes.

25. The recombinant yeast host cell of claim 1, wherein the recombinant yeast host cell further comprises a deletion or alteration of GPD1.

26. A composition comprising a lignocellulosic material and a recombinant yeast host cell of claim 1.

27. A method of producing a fermentation product, comprising:
(i) combining a recombinant yeast host cell of claim 1 with a lignocellulosic material;
(ii) allowing the recombinant yeast host cell to ferment the lignocellulosic material; and
(iii) recovering a fermentation product produced by the recombinant yeast host cell,
wherein the lignocellulosic material is insoluble cellulose, crystalline cellulose, pretreated hardwood, paper sludge, pretreated corn stover, pretreated sugar cane bagasse, pretreated corn cobs, pretreated switchgrass, pretreated municipal solid waste, pretreated distiller's dried grains, pretreated wheat straw, corn fiber, or agave, and
wherein the fermentation product is ethanol, lactic acid, hydrogen, butyric acid, acetone, or butanol.

28. A recombinant host cell, comprising an acetylxylanesterase, xylanase, and xylosidase.

29. The recombinant host cell of claim 28, wherein the acetylxylanesterase comprises an amino acid sequence that is at least 90% identical to a sequence selected from SEQ ID NOs:6-10,
wherein the xylanase comprises an amino acid sequence that is at least 90% identical to a sequence selected from SEQ ID NOs:37-62, and
wherein the xylosidase comprises an amino acid sequence that is at least 90% identical to a sequence selected from SEQ ID NOs:78-92.

30. The recombinant host cell of claim 28, further comprising a galactosidase.

31. The recombinant host cell of claim 30, wherein the galactosidase comprises an amino acid sequence that is at least 90% identical to a sequence selected from SEQ ID NOs:108-122.

32. The recombinant host cell of claim 28, further comprising a mannosidase or mannanase.

33. The recombinant host cell of claim 32, wherein the mannosidase or mannanase comprises an amino acid sequence that is at least 90% identical to a sequence selected from SEQ ID NOs:146-168.

34. The recombinant host cell of claim 28, further comprising an alpha-glucuronidase.

35. The recombinant host cell of claim 34, wherein the alpha-glucuronidase comprises an amino acid sequence that is at least 90% identical to a sequence selected from SEQ ID NOs:184-198.

36. The recombinant host cell of claim 28, further comprising an acetyl esterase.

37. The recombinant host cell of claim 36, wherein the acetyl esterase comprises an amino acid sequence that is at least 90% identical to a sequence selected from SEQ ID NOs:223-225.

38. The recombinant host cell of claim 28, further comprising a glucosidase.

39. The recombinant host cell of claim 38, wherein the glucosidase comprises an amino acid sequence that is at least 90% identical to a sequence selected from SEQ ID NOs:226-227.

40. The recombinant host cell of claim 28, further comprising an endoglucanase.

41. The recombinant host cell of claim 40, wherein the endoglucanase comprises an amino acid sequence that is at least 90% identical to a sequence selected from SEQ ID NOs:289-345.

42. The recombinant host cell of claim 28, further comprising a glucuronyl esterase.

43. The recombinant host cell of claim 42, wherein the glucuronyl esterase comprises an amino acid sequence that is at least 90% identical to the sequence of SEQ ID NO:346.

* * * * *